United States Patent 10,233,495 (METHODS AND COMPOSITIONS FOR SCREENING AND TREATING DEVELOPMENTAL DISORDERS) - sequence listing, part 44

SEQ ID NO: 507 - DNA, 33862096 bp, Homo sapiens (residues 1-2,116,381 of 33,862,096)
tggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggaga[136 bp omitted]atggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctca[133 bp omitted]gcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtc[138 bp omitted]gcctcagcctcccgagtagctgggactacaggcgcccgccaccacgcctggcaattttttctatttttagtagagacggg[148 bp omitted]ggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatg[136 bp omitted]aaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaaaaaatgttaccactggctgcaacatttttttcattaaacataaaagttggtcttgggggtgtcattcaatgccttttctgcttccttcagaattctaaaggcttccaccacaactttgatctgagcccagttatgaacttcatacaaagctgcagggaggagcctgtgtctgttgaagaaaggctcacaagatcccatggtaaggggagaggagaaggggtaatgaggaagaaaggcagctttccaggggccgagtccggaagaccagacttgtcagagaatggaactagcttgtccagtctcagcccatgagagagtttcacgccacgtgctattctggttctgaacattgagcacttgggtgacttggaatggcctccatctaagctgcatcttcccccatagttccaaatataaatgcaatgcattccctgggttcctgccagccattgtcacgtttttgcttcacagctgtctcctccctgctccccgtcctattcatctgccccttgctagacaggtattcatgaaacatgactgcttgtttatgaatagctgggatgtagacatgacatacggaaagagaagctgccaatttttccccaaccaaaagtgaaaacagtgcttggacctaacaagcatagaatgtttgatcccatagcagagctggtgggaaggctgggggcaaaatctgacactgtccaccattggctgtagaccaaagggaggctgcagaccaaagggaggccgcagggaggtgagatcatttcaatcgcaggtccccacccactacgagcacttcctcacccacatcctctgttctaatcttttctgtctatctcttatcaacttccaacatatgataacgtatcaccttttattgtttctctcccggctccatccccactagaatgcaactgctacaaaggcatggatttgtccccagtttccagaaacatgactggcatgtagtagatgctcattaaagacttatttatttatttattgagacaatgtcttgctctgccgcccaggctggagcgctgcagtgtgatcctggttcactgcagcctcaaactcctgggctccaacgatcttgtcacctcagcttcctgtgtagctggcacaacaggcatgtcctaccatgcctggctaatttatttattgtttttgtagagacggggtctcactgtgcttcccaggctggtctcgaactcctgggctctagtgattttcccaccttggcctcccaaattgctgggattacagacttgagccaccacgcctggccctaaagacttattaaacacacgggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacata[138 bp omitted]cctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcc[133 bp omitted]taggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacg[137 bp omitted]gtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttg[314 bp omitted]aacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaaga[187 bp omitted]ggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctccctagcacactcctcttgactatcactactatgttttgattgttcaacgtgtaaaacagtccaatttattatttttttaatgtttaaactgttcctttttttttttttttttaaacgacacagggtcttactctgttgcccaggctggagtgcagtggcatgatcatatagctcactgctgtctcaacctcctgggttcaactgatcctcccatctcagcctcccaggtggctgggactacaggcaagagccaccatgtctggctcaaattgtaccagatttaccagtgggactctcctcactttagatggattcttaagtctatgaactaatcccattagtctttttaaatttttatttatttttgtttgagacagagtctcgctctgtcacccaggctggagtgcagtggcacgatctcaactcactgcaacctccacctcccgggttcaagtgattctcctgcctcagcctcccgagtagctgggattataggcgcgtgccaccacgcctggctaatttttgtgtttttagtagagacggggtttcgccatgttggtcaggctggtctccaactcctggcctcaagtgatctgcctgccttggcctcccagagtgctgggattccaggtgtgagccaccgcacctggcccccattagtctttgatcacttccttgcttcctggcaaaatgagattctccagaaccatcatagattttctcccctcacacctggggccaggcatttctccaaggtcttatttttaagaacaagccaatttttatgttctaaattgacttcacacctcctcagggaaacgcagccagtagtttaaaaacatctttgtaacaaatgaacgctaagccccacatcttctctccttatctataaaagagggattacaataccacatgctcatgggaattttctgaggataaaacgagacaataaacataaagctcttagcacagtctgtgggaacaattaagcatgaaagcatgagctgctgctctcattgtcaacatccgattgaaatcttgtttttgagacagggtcttaccgtgttgcttaggctggagtgcagcggcaccgtcagggctcacagcagtcttgacctcccaggctcaagtcatcctcttgcctcagtccccctagtacctgggacgacagacttgcaccaccatgcgcaggtaatttttttttttttttttcagtagagacagatttcgccatgttgcccaggctggtctcgaactcctggactcaagcgatctgcccacctctacctcccaaagtgctgggattacaggtgtgagccatcgtccctggccttattgagatctttagagatactgccaataacttgggttttaaaaattatattgcttgagcccaggaggtggaggctgcagtgagccaagatcacgccactgcactccagcttgggtgatatagtgagactatgtctcaaaaaaagaagaagaagaaaaaattaccattaagataaaaaatgtttatgactgtgtatgacgtttacaaatttagccagcctacgcaacagagcaagaccctgtctcaaaaaaaaaaaaacttagaaatattagtaaacatggtagacgcctgttcattaattctgcttgaacaggtggtcaaggaaaagaaatgacttgaatacagctaagggcttttattcagcagatcctcaccagacggcccctgtgcacagataattgattcactgtggcacagcaggatctgagttttgtaagatgaggagagaggggtacatgtttttgaggactggcccaaatttcacttttctggccaggcgcagtggttctcgctggtaatcccagcactttgaagggccgaggcgggtggatcacttcaggtcaggagttcgagaccaacctgacaacatggcaaaaccccatctctactaaaaatatgaaacctagccaggcgtggtggtgtgctcctgtaatcccagctatttaggaggctgaggcaggagaatcgcttgaaccttggaggcggaggttgcagtaagccgagatcgtgtcactgcactccagcctgcgcaacagagcaagactctgtttcaaaaaaaaaaacaaaaaccaaaaaacaaattacacttttcttcatcttcagctgttgcaaaacctggcatcgtgtccattggagactgtcgttgctgtggtttcaatacctctttcatggtattatgggtgcaatcccttttcagcaactctcagaacagtttattttgcaaggctttgcaatatgtcaaggttcaggggaaagtgggggtaacaaaaagggaggagaggagaaaacggaagagaaaaatataggaaaaggaggcaagagttgaagcaacataaactggggtctctctatgttttattgtagtgcaaacacaaaacattaaatttattatcttaaccattttcaagagtacagttcaggccagctgcggtggctcatgcctgtaatctcagcactttgggaggccacggtgagtggatctcttgagctcaggagatggagatgagcctgtgcaacatgatgaaacctcgtctctacaaaaaaaataccaaaatttaaaaaagggggggagtagagttaagagttcagtagagttaagtctaatcacattgctgtgcatgggtctccaaaactttttcatcttgcaaaactgaaactctgtgcctgatagcagtggggagatccgagttaccctgagttaccagtggcgaatctgtaggggtctgcggcaatttcaatacttgcctccttggaagaaagaatttgactgagggcgtaaggcagaaaaagagaccaaggcaagtttcaaagcaggagtggaagtttattttaaaaagccttagaacaggaggaaaggaaggtactcctggaagagatgcaagtgcatgcctgaaggtcaaagagagcgagagcgagggagtctaaccttgatcctgggagtttacgtgctggcctctttcttacccatgattcttcccttggggtgggctgcccacataagcagtgccctccttacccttggaaagtgagcatgtgcggtgtgtttagggattgtacgaatgccggtctgagactttcttccttttctggtggaggctcccggaaggtcatacttcatacttcaccatttcatctcttttccctggcatttgcagtcaattaacactttaatgttaatagctgtgttactggaaaggagtccagatccagaccccaagagagggtccttggagctcgtgcaggaaggaattctgagtgagttcataaagtgaaagcaagttttttaagaaagaaaaggaatacacgaatggctcttccatagacagagcagccccgaggtctcctggtttcccatttttatggttatttcttgatgatatgctaaacaaggggtggattattcattctttccctttttagaccatacagggagacttcctgacgttcccatggcatttgtaaactgtcacagcgctggtgggagtgtagcagtgaagaccaccagaggtcactcttgtcaccatcttggtttgggtgggatctcgccggtttctgtactgcaacctgttttatcaccgagggctttgtgccgacctcccgtctcatcctgtgactatgaatgcctcacacacctcctgggaatgcagcccagcaggtctcagcctcatgttacccagcccctattcaagatggagtggctctgcctccagtgcctctgatagtgtcacaggccgtgctcactcacatttggctcagaataaatctcttcaaatattttagagttttactctttatcggcatcatcttgtccaattccaatgaggagctcttgaaagctaaaaccaagaagtcttccccatgggagaagcacccccaaatcttgttctcaccaatcaggcgcattcgcggttcttcctttcctccccttctcctcctgcaccacttgctgcttcccttctcccacgaatgctctccaggacctgctgcacttctcacagtgccctaactctcggctctgcaggaaaatgacttcacaggaatttctccttgtaaagattttataacccaatggatggaccctgatgggacaaaacccaggggtgaaaaattaaaatggcaatgttactggagacgggtccctatctagattccaagagagggttcttgtgttgtacccgagcgagttagaaaaacgccacactttgagacgatttaagagtcctttattagccggcgaccgagagacggctaacgctcaaaattctctcggccccgaggaaggggcttgattaacttttagatcttggtttaggaaggggagggcggggggtctagtgaaaaccattttacagaagtaaagtaggcaaaaagttaaaaggataaatggttgcaggaaagtaaacagttccaggtgcaggggctttaagactattatagacgcgaggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtagaggaaaagggagagtctaaaaacaggttagtaaaaaccaggttgggcattacacttggatcttgcggcaagaaagaattcggggcgaatccatagagtaaagtgaaagcaagtttatcaagaaagtagaggaataaaagcatggccactccatagacagagcagcagcatgggctgttggttgccttttttaatggttatttcttgattagatgctaaacaggggttggattattcttgagttttctgggaaaggggtgcgcaattcccagaactgagggttcctccccttttagaccatatagggtaatctcctgacattcccatgacatttgtaaactgtcatggcgctggtgggagtgtctcttagtattctgtgctttataattagcatataatgagctgtgaggacagccagaggtcacatttgtcacctcttggttttggtgggttctggccaggttctttcatgcaagctgttttatcagtaaggtctttatgtcctgtatcttgagctgacctcctatctcatcctgtgacttagaatgccacacctcctgggaatgcagctcagcaggtctcagcctcattttacccaggccctattcaagatggagtggctctcattcgaaagcctctgacagcaagattgaaatagcttcaggagggctcatccagctcatgggctattctgaacctctctttccttccttcattactgtcttctaccccagttcgggtcatgtgacttggtgacttggcctctgtccaagaacactgagatatcttatttgtcattttgtacactggtcagtgatcttgcattcaaatggatttcttctctcagaggggagtccattggggaagtgaagggtcaaaggccagccagaattcataggatagagtcggcagagagcctggaaagcgggaatcttgttgatggctggcagaggccagtataggcattctgccttttaggaggttgcgtagagtcttgtagaagacaatggcagctgtttgggcattctttggcagtgttgtggattttgctgttgctatggtctcaatgcttgccttgaacattgtgtgccttgaacattcatgtgttgaaacttaatccccaagacaatagtattaggagatggtgcttttaggaaacaattaggggtctagactcatcaatgggataagtgtccttataaaagggaccccaggccaggcacagcaggtggctcacacctgtaatcccagcactttgggaggccaaggcagctggatcacctgaggtcaggagttcaagaccagcctggccaacatatagtgaaaccacatctctacaaaaaatacaaaaacaggcatggtagcacacacctgtaatcccagctaattgggaggctgaggcaggagaatcgcttgaatccaggaggcggaggttgcagtgaactgagattgtgccactgcactccagcttaggtgacagacagagcaagactccgcctcaaaatataaaattaaattaaattaaaaataaaataatgaataaaataaaattaaaaaggtgagccattgtgatggatggaaatcacgtaaacctggaccaattcaggcaaagatgttgatgggacatcacgggtaatagccattcctcagagactacctgccaaattgctccccagctgtcttagtcaatttaagctgccataagaaaacaccatagactacacggcttaccccaaccagcatttgtggctcacagttctggaggctgaagtccaaggtcaaggaatggcagattcagtgtcttctgaggacccacttctgttgcctggtccaggctaaactgtaaccataataggttcgttgcatgcagcatgtctgtaccccaactctcagggctgcagaagagaaagaggtttaatcaaaaagaaagaaagaaagaaaatgaaaatgaaagagacacacagaaacattccactggttacagctcagcgtttgccttatttgaacatggttagaacagttggctccctgtgagtggttgaagtatggctgctgggattggtggagatgtcgcttgttacagaagcatactcttaagttaggtgatatggtttggatgtgtgttctcacacaaatctccagtgttgaaggtggggcctggtgggagatgaccggatcatgggggcagcggtttctaatggtttagagttctcacgagatcgggttgtttaaaagtgtgtgacacctccccactctgtctcggtcctgctccaggcatggtaagacacgcttacttcccctttgccttctgccatgactgtaagtttcctgaggcctccccagccatgatctctatacagcccgcggaaccatgagccaattgaacctcctttctttctaaattatccaggctcaggtagttctttacagcagcgcaggaacagactaataccttagcttttcagtccgcccgcctacctgccaagttaggttacggttcacccacaaggactcaagtatgagagtacagagacattctcaggccagattttagtttgatttaatagttcagattcttctgcatccctgtatcttcagaaataaggatgttccctaccatttgatccagcaatcccattactgggtacctactccgaggaaaagaagttattatttgaaaaagataagatacttgcacatgcatgtttatagcagcacaattcacaattgcaaaaatgtggatccagcccaaatgcccatcaatcaatgagtggattaaaaaaactgtgatacatatatatatacacacacacacatatatgtgtatatatatatatacacacatatatgtatatatatatacacacacacccatatatatgtatatatatacacacacacacatatattcattcctttttatggctgagtagtattctatcatctatatatatatatatatatatatatacacacacacatatatgtgtatatgtgtgtgtgtgtgtgtgtgtgtgtgtatatatatatagatgatagaatactactcagccataaaaaggaatgaatgaatggcattcacagcaacctggatggaattggagaccattattctaagtgaagtaactcaggaatggaaaaccaaacattgtgtgttctcactcataagtgagagctaagctatgaggatgcaaaggtgtaagaatgacacaatggactttggggtcttgtggagaagagctggaagggggtgagggatagaagaccacacacattgggttcagtgtatactgttcaggtgatgggtgcaccaaaatctcacaaattgtcactaaagaactgactcatgtaaccaaataccacctgtttcccaaaaacctatggaaacaaaacaatttaaaaattttttaaaaagaaattaaggatgtttctttcctctgggtattaaggcacctttcaaatgagggtggtttgacctgcttcaggagagaaagatgagaggaaggtcagagagaccatcccgcttctgctgttttctccaatgccaaggggccatgttttggggcggcacgtcctgaaacccctcacaagcaacataaatgaacctggattgcttaaacaacaccatccaggcatggtgagtgtgtggggtcattcgaagagtaaggaacgtagaagagctagtgttataaaatggcgaaatcaagaacagcctgtggacagcatgcagcggtggctttatgggattactgttgtgagatgctcagggtgaacgtgggagaatccaagcctgagaccctggctcctccttggcttggatcggggagagcagaacaccttgatctactatcccaccttgtcccctgtagggaagtagaagagccatagccacgtgaggtgatgtccgtaaaagagcgagattgctgtgtgacatacagaacaaagcccaccgccacattctcccttcctgattcttcagcctgatcagaatgtggctttgttcatagactaatggctaaattggcaaaatgccccaagatacggagttgcagttgcgaaagagccacgattgctgtgaagattgtagaagctgtgatctgcaaagcacggagagcaaggcctggctcatgtcaaggactcaataaatgtcacagctgtactcattatttttaccctgaggccacatcctggcacagggagaagggtgattatccattatacgaggtctggctgtggattgggatggcagtgcattagctgtttcttatgtgcatatagagaagtctgctcaggggctgtgtctttgcaagctcatgccctctaagcagctgctttagaacaggtgaaaattggccaggcacagtggctcatgcctgtaatcccagcaatttgagaggccgaggtgggcagattgcttaagtccaggagctcgagactagcatgggcaacacgacaaaacctcctctgtataaaatatacaaaaattagatgggcgtggtggtgcacgcctgtggtcccagctatttgggaggctgaggtgggagtatcactagagcttgggaggcagaggttgcagtgagcaagattgtgccactgtactccagcctgggtgacagagccagaccctgtgtcaaaaaaaaaaaaaaaaaaaaaaaaaaaaaaaaaaaaaaaaaaaagccaagtgtgtggctcatgcctgtaatcccagcactttgcagggctgaggtgggcaaatcacctgaggtcaggagtttgagaccagcctggccaacatggtgaaaccccgtctctaccaaaaatacacacagaatattggccaggcatggtggcgcatgcctgtaatcccagctgctcgggaggctgagtgaggcaggagaattgcttgaacccgggaggtggaggttgcagtgagctgagatcaccccactccactccagcctgggcaacagagcgagactctgtctcaaaataaataaataaatagaacaagtggaaataaatgagacgtcccccatcccaaatgttttcgtcccaaatgaaaatgagcagaggccacttattcagagctagccctagtaagggagtcagacatcaccctttgcattttggcagggaccgaaagacaagtagaggaggctttatagtgtcagacctcaggatacacgtccccaaacatgactgctggcaaccagaatataccagcccaacatacccattactttgagctgaaacactgagaaccagctaatacaagaggagctctttacttgctcctcgacagctaaaaataaagtacaaatttcccctttgaaaagagaaatttaggccagacatggtggctcacgcctgtaatcccagcacttttggggactg[134 bp omitted]gaggcaggagaattgcttgaacccacgaggtggaagttgcagggagccgagatcatgccactgtactccagcctgggcgacaagagtgaacaaaactccatctcaaaaaaaaaaaaaaaaagaaatttttgttttgttttgttttgtttgtttgagatggagccttgctctgtcgccaggctggagtgccgtggtccgatcttggctccctgcaacctccccctcccgggttcaagcgattctc[134 bp omitted]gcctgccaaagtgctgggattacaggcatgagtcaccccacacccagccgaaatttggtaaactcaatcaagtttatttatttatttatttatttttttaatgggtcgcgcttttggtgtcttattttcctaacccaaaacgaaaaagactttctcctctgttttcttctgcacatgttatagagatcgcacttacatttgggtctctgatccactttgagttaattttggtgcagggttttccattcacggaacatgaagttggatttctaataggtcaatatatgaaaaatttcccgcaaagtttttcttttcttttcttttttttttttttttttgagactgtcacccaggctggagtacagtggtgcaatcacagctcactgcagccttgacgtcccaggctctagagatcctcccacctcagccttccaagtagctgagaccacaggtgtgcaccaccacgcttgcctgattttatattttttgtacagacggggtcccactgtgttggccaggctcgtctcgcactcctgggcttgagtgatccttccacctcggtgtcccaaagtgctgggatgataagcatgagccactgcactcggccagtttctagtttggatatttgagtggacttcccagcccccacacagcatgctcatttcgtgtaagattgtgagagagtgcgaggagagaaagagcatgcagccagcgttggagcttcggagacatcccgggcaggagcttcccagggtctcatttgttctgtctcatggttggcacacgaaggacagtgagaggaatcttggtttcagggggcctcaaaccagacatttgaggaggtaggggaggcggttgccactccgctcattcagtgcatccaggctgtctaactggttaggccacttgcaaatgtgcaaaccttaagtaaagaaacagactctggggtcaggggggaggtttgaactgtaactagcgcgtcataaatcccagcccttatcttgaacaagagtcaaagaccggacttgaaggcatcccccaagataaaggtaggccctctgcagggcagctgtaagtcagctctcctccacccctctggctggccccctccttatccgagtcctgcttccttcctctttaaatctgcagacaatgctgcttctctgcaggtctctgcatattccctcagctcacagaccggctgcatacttggtattttcagggttaggtttgcaacacatgactggggaaatgcatgaaaaggaaatgatgcaagaattcaccgcggacacctttaggtgagaaggagatgtgacaaaaagtctctgcctggccaaaccgtagccaggctcctgaagcccctcccaggcccggtggtgcgtttccttatagaattagatttcagcaaagtaccggctaagtcagtttggcgagaagccaccattcttgatatcatgttcctcgtcgtccaccacccctggttgatgtttaacccccttggctggctttaacaagccaggttggtttagccaggacccgcttcacctctgatgtttccttttagtgctttgccatctgtacacccgctgcctgcccccgtggctgtacattcccacttgcccttgctgtgttcatattggaagctgagcccagcctctcctgcactgtgaaccgccattgcagtggtccctgtacttcacacgataagcctggataatgtcttcgttatctttttggtgatgctttcccaagtacgaggttcgtgcaaaagtaataactgcaattaccaacctagtatcactgaatagttttttctttaacaaaggttttgctcccggacgaatgaacgagtgctggctgcttgttcttggggctcaacaatgaggtgcagacagactggggagaaggggatttatttctccaacgggttacagggagaaggtcagattaactcaccaggtcagctcaaagtgacaagttttttccagggtttctatgcattttaagctctatgcccacgtgtaggattgcacctacgagcgggagtatttcattcggttcctgtctaatctttaactagggtctggggtctgggaagttttctctagacgcttaatcttcagtgagccctggtatgacgtgtttaacttgtgcatcatcagaattataataaagcgttagtggaaaaactggttgctccggctgctaatggaagcctggcctgccacagtttgactcaaagggaacctaactctcaaggagccataatcccagcactttgggaggccaaagtggaggattgcttgtgcccaggtgttggagaccagcctgggcgacataggagaccccatctctatacataaaagaaaaattagtcgggcatggtggcttgcgtctcttgcctcagctactctggaggttaaggctggaggatcgcttaagcctgggagttggaggctgcagtgagctgtgattgtaccacagcaccccagcctgggcaacagagcggaaccctgtctccaaaaacaaaacaaaacaaaataaaaaacaaaagcaaagagccatacaagaaagttttaaagaatgtattttttaaaagccccagtgaggttttctgcagaaatcctgggtgcttctaagccagccagaacctctacctttaaagcatgtctgctcatgtcataggtcttacaggtatggaggaaagttgaggtttttaaatttaaaaaaatataaaaaagaagatgaacacttctgaatcttcttttttttccttttgagcatgttctctgggtggggaatgtgctatggtttctgaaaacaaagaagaaaacatgtcatccttctgttccaggttctcacgatggtctaagggaatgtgatttttttttttttttttttttaatggatagcatgatagtggcatggggtgacgtggaggccaaggacagagggtgaggtattcagcctggagatgacctttaacctcaaggctttcttccttttaaaatgtttgcagattgtttgttttttgtttttgtttttgtgtttttttgagacacagtcttgctcttgtcgcccaggctggagtggcatgatctcggctcactgcaacctccgcctcctggttcaagtgattctcctgcctctgcctcccaagtagctgggactacaggtgtgcaccaccacacccagctaatttttgtatttttagtagagacagggtttcaccatgttagccaggctggtcttgaactcctggcctcaagtaatccacccgctctggcctcccaaagtgctgggattactggcgtgagacactgtgcccagtcaaacatttgcttttttgacaataatttattgggtttttttttttttttttttttttttttttgaggtagagtcttgctctgtcacccaggctggagtgcaatggtgccatctcagcttactgcaaccttcacctcccaggttcaagcaattctcccacttcagccttctgagtagctgggattataggcgcccgccaccatgctcggctaatttttgtattttcagtagagacggggtttcaccatgttggccactgtggaactcctggcctcaggtgatccgcccaccttggtctcccaaaatgctgggattacaggcataagccactgtgcctggccaattgtatatttcaaaataactagaagagtatatttagaaatgttcccaacacaaataaatgataaatatttgaggtaacggatagcccagttacccagattggatgcctacacattgtatgcttgtatcaaaaatatcacaccaatcccatagatctgtgcagttctgatatattcataaaagttaaaagttttaaaaattgcctggcacagtggctcaaacctgtaatcctagcactttaggaggccaaatgcgaggactgcttgaagccaggagtttgagaccagctagggcagcatagtgagaccccatctctatgaaaaatacaaaaattagctgggtgtgttggtgtgcgcttgtggtcccaagggagcttgggaggctgaggtgggaggattgcttgagcccaggaatttgagaacagcctgggcaacatagcaaaacccagtctctacacaaattttagaaaattagctggaagtggtgacacatgcctgtggtcccacctagttgggaggctgaggtgggaggattgcttgagcccaggtagttgagactgcaatgagctgtgatggtgccactgcactttagcctgggcaacagagcaagaccctgtctcaaaacaaaacaaaagaaacaaacaaaaaaccctcagaaccaactgttcagataacaaaaaatgactttatgattacattaggcccacccaaataatccagaatcacctccccatattaagacacttaatttcatgaaatctgagaagtctgttttgccatgcagtgtgatatggtttggccgtgtccccatccaaatctatcttgaattcctaagtgttgtgggagggacccggtgggaggtaattaaatcatggaggcaggtctttctcatgctgttctcgtgacagtgaataagtctcacgtctttctcatgctgttctcgtgatagtgaataagtctttcgtgatatgctgatctcgtgatagtgaataagtctttctcatgctgttctcgtgacagtgaataagtctcacgagatctgatgattttgcgcaagctcttttctctttgcctgccaccatccttgtaagatatgacttgcccccccttgccttccaccatgattgaggcttccccagccatgtggaactgtaagtccattaaacttctttcttttgtatattgcccaggcttgggtatgtctttatcagcagtgtgaaaatagactaatatacaaggtgacattatacaaggtggttaagggttgactggtgtttcttcccccacaattcatatgtggaagatctatcccctctccatctgtgaatgtgaccttatttggaaatgcagtgtttacagatgtcattagtttagatgaggtcatcctgcaggaggataggctgtaatcccatgactggtgtctttatgaaaagaggaaatttggacacagacacacacagaggagaacaccatgaaaccatggggcagagactggagtgatacaaccaaaaacccaggagcacctggagttgccaaggtctggaagaggcaggaaggatcctcccctatagcctcctgagggagtacagccctgagacaccttgatctcagcctcctggactccaggactgggtaaggataagtatctgttgtttaagcccctggtttgtggtaacttgttatagcagccacagaaaactaattcagacatattcatagactccagggattctgatgtctgtatcttgaacagcatgagggatcattattaagccattggcagggctcggttctaattgtggccatggattgcctttggtctgttggacacgtccttttctctggaacagccatggcaactccatgtgattagattaggatgggattctagggtggagatcccattccaaccatgggtggacatttaatccaggaacggccaagtccttcagccataatgattggtaccaagatgggtgatatcgtttggctgtgtctccacccaaatctcatcttgaattgtagttccataatgtcctaaacattagaaacggtaaatgttagctaacatggcaaaagggactttgcggctataatgagttaagaatcctgagatgagatgatcctggattatcctgatgggttctaagtaatcacaagagtccttataagagggaggtaggagtgtcaaagtcagagaaggagatgtgaagagggaagcagaggtcagagagagagagagagagactggaggatactgtgctgctggctttgaagatggaggaagaagccataagccaaggaataccacagcctctagaagagggaaatctcaaggaaatggattttcttttggaacctccagaaggaaccagcctgctgacaccttgatttttcgacttctgattaccagaactataagaaaaattgtgttattttaagcaattaagtttgtgacattttgttacagcaccaatagcaaactcatacactcctttaatggtcttttaacctcaggtcctctctctctctctttcttctcctcctctttcccttctccttcttctttttctctcaatctctctctctctcattctctttctctccatctgttctctccagaagggcagatgaactttttatttacatgggggctcttgagtccataagagagaagtcagaagctgccaggtctcctaagtctagggcaggaaggatagtatcagcatcacttctgcggcattctgttggtctatgcaaatcagaggctcatcctagatccaaggggaggaaaaaggctccaacttgtagctgggctcatttggaaggtaatgggaggacttggcagctgtaagacatgtaccacatctagacttcaacctacagaaaagtccaaagatacaccaacagcagcccaagttagtcaactgaagctggctcaaggctgccccctttaggtggagactaaccagctccctgacatccttcagttaactgcaccttcctcctttttgctgcctggaatgtctacatgctgcctggagctatggcagccatcttgtgaccatgaggcaaaccctatgtgcaagagcaggaagctggaaagaacctgtcagccctggattgcttcctctgtgacccccattacctgggagagaacacatctttctcttgtttaaggcgttcttattcccagtcgccctctctcccctgtataaccctaaaagcacaggagtacacttgtgactgtgacttaagtttttcagaacgggggagtttggattgtttagtcctctctccatgaatagtgaatagcaatgccaggtgagttccttcaaagctggggggtgaaggggtggaggtggaaaagtaggattgaggatgggaaataaaaacaaacaaatgacaccatccagggagatttgtcacattttattcagtatttctgctgcactgccagcctagggatgcacttgattcccaagaaatgcaactgtcctattcgcagagccgtccacaggtacctaccccctggactgcagcaactttattaccttaactagcacagaacagaggttgatttaaactccttacactcacttctcagatcaatgaatgggcaaagaaacacctcatggctctgggaaggcatgctgagacccgtttttgcaagtcctgaggaatggaagaatatagctgccaggtatcccaagtctagggcagggagggtagtatcggcatcactttcactgcattctgttggtcaacgcaagtcagaggctcagcccagatccaagggcagggaagaggctccatcgtgtagttgggctcacttggaaggtaatgggaggagttggtggctgctttaagacacataccacatctagatttcaacctccagaaaagtccaaagatgcactcacaggagcccgttagtcaactgaagctggttcatggctctcttcttcaggtggagactaaccaactccctgacctccttcggttaagtgctccttcctttttcctgctgcctggaatgtctatgtgccatctggagctatggcagccttcttgcaaccatgaggcaaactctatgtgcaagagcaggtagctagaaagagcctgccagccctgggcttatatcctgcttcccagggagcttaaagatagcaaaacccacagccattttcatcaaatgccaggaaattcttaggctgggattgttgggattgtttgaatggttgagcgtgaaagacttgttataatgggcttgttgaatacggtgaaagatgagatggcttttagctgcctccactccccgtgtcccatgctccatagatgtttctttttttttttttttttaatcattttttggttatgccaggtgtctcctgtgtgtccctccagatccctctccagccctagaaacctgagctctataaatgttgcctctctccactcatcttctctttggcttcaggttgagttcagccaacagatgcccctgtaggatttggacacagggagccaggggagaggggcatcagctgcctggttagcagggctgtgatgattcttctacctatgactctcagtgctgttgcctcttcctctggatcttggaagcttccatgctgaggtctgaaggtggctccctgcctcccactgatgtccttagaatcccatcctcacctaatacctggtattgaacactgcctttcttagatgtcatttaggctctcgtttcaattcccagtatgcttcctgcaaagacctcgatagatggactgaggggaatagtgcaaggtcctcccatccccagtattgggatctaggggcagggggtcccagctgtgcagtaggttaggactacacttccatcatcaaagccacagagggaagaggtgaggatgaaacacactagaattgacttagaaaacacactggccaaatcttagctatttgaggaatgtagggagaaaagccaccttctctctctatgtctgaaggttcccatggctgtctctttgcccaaggggcaaactttccatcagggcatcttctgtgcctctgaggatcattttccaattataggcaatggtagtacgtgtttcagtgcagaatgagatagagttgtttaatttgacaataaagcgatgcgtcaaaaacctcagtcaacacagtaagtgttttcttgttttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttccccttgatcggctcattacttggaagagaacacacccttctcttattattttctttaaggcatttttttttttttttttttaaggcagggtcttactctgtctcccagcccggagtgcagtagtgcaatcttagctcattgcagttttgacctcccaggctcaaataatcctcccgcctcagcctcctaagtagctgagactacagctgtgcgccacgacatctagctaattatttgttttttgtagagatgaggtctcactgtgttgctcaggctgggtaggtgtctaactcctaggctcaagtgatcctcccaccttagcctcccaaagtgctgggattacaggtgtgagtcaccgtgcctggctttgtttaaggcattctttttccgcagcatctgttaccagcagcctgaagccatttctataacaatatcaggaagacacatggacagagaccctaatgtatgaaaaatgcatcaattatttgagattaatgagtcctcataaacagagactgagaggctctaactttcctccgctatgtgagagtaggaacagacactcctccctgtccttttgtaaggctgttatgtcatctaggtgatgaaattgcaacaatgctttaagacggaggggtgaaaacatcgggcattggcacaatgacgaaccctgagatttagaagaggaagaggaggcatcagtgggtgcctactgggacagtcttatttcacaaatcaggaaagggaaaccctacatgggcgcagtggctcgtgcctgtaatcccagcactttgggaggctgaggcaggtggatgacttgaggtcaggagtgcgagaccagcctgggcaacatggtgaaaccctgtctctactaaaactacaaaaattagctaggcatggtggcaggtgcctggtgcctgtaatcctgggtactcaggaggctgaggcaggaaaatcgcttgaacccgggaggcggaggttgcagtgagcagagatcgtgccattgcattccagcctgagggacagagcgacactctgtctcaaaaaagaaagaaagaaagaaagaaagtggggacccactctcagtccagggcatgttccttgcaaaaagggaagctgaagatagaaccaagcttggagaattttgtttgcaacgcagtcaggctctcctggatcctctctcacagtcctggcattcagggggtgccatccccatcctcgtggcatgaacagaacgggaaatgtccgcagcacggctgcagccacggcttccacaggatgttgctcatggaaaactgctggggcacaggactcagggtctgccgatgctccgacaccgcggcacctacccttgctatcacggcgtggtacaggggctcggagtcgggggtcaggggccgtgcctcggaggggtccctggagaggtcaaagagcaaagggggtctgtgatgggtcacgccctccccggagcatgggcagacgcctcggccgtagcaggcccccgctccctcggggtggaactgcggggtcgtgtaatgaaccttccagacgcttccacctggatgcagacaagaagggagtcagggtggcagaaatccacgcaggtgtgaacgcagaacgcaggtgtcggccctgtggtatcagcatgaacctccctattcagtgaaaaggaggagggacacgaggcagtccacacaatcacagccttcagcttgcaaagtcagagcatgtgtgtgtgcgcgcgtgcgcccatgtgtgtccgtttgtgtctctgcattgcatgccccaggcaaagggactcattgcagagcgctcactgtggctgctttcagaaatcagaatcatagaggttccttaattcttcccctttcccctgtgttgaaactgttcagcgtcgatctactacctttctacacagaaacaaccatgatattttaaacagcatgattgggtacttatctatctatcgctacctatttatctatttatctatcaatccatccatttatcttacccatcgatctcatctatctaccattatctatttatctatcgatcatctatctacctacctatcatctatctctgtttatctacctttcatccatctatctgtccatccatctattcatccatccatgaactgattctactttttatctatctatctatctatcatctatcttatctatccatcatctatcttatatatctatcatctatcttatctatccatcaatcatgtatcttatctatcatctatcctacatatctatatatttatccatccatcatgtatcttaaatatctatccatcatctatccattatctatcatctatccatccatcatctatcttatctatccattatctatcttatctatccatcatccatctcatctatctatctatccatcatctatccattatgtctctatcatctctctctctctctctctcccccccccatcatctatctataatctactcatcggtttatctatctctatttctatagctatctgtccatccacccatccatccatccatccattcatccatccatccatccatccatccacatatccacacatcctattggctgtttctctggacaaccctggctgtgggcagcaggtactcactgtccttctggtgccagcgtgctgcgtgaagatgctgcccacagtaatgaaacaggaactcatgtgccgagcgtgcctcagctccctgcagcaagggtaccaggctgtggccatcaatcaccctgatttcatgaagagaacacagagcagagtcagaccacgggttcccaggcagccttttgcacctgggaacacatctcccagaatgcaaggctccccagcaaatggagcagagatgagctgtctctccagtcgctgttcagattacaggttgctgagcaggatacatgtggttatttcaagacacagtgtctctaagtgttggggtcatttgttatgcagcactgcataagcagagtgcacacacacacacacacacacaccccaacacacagcactgtcaccttggaggtcaacacaaagccttcaaattccagctggacagcccacattcctaggttggcttttcttacttttttttttttatgaggcagagtcttgctctgtcacccaggctgcagtgcagtggcacaatctcagctcattgcaacctctgcctcctggtcaagtgattctcatgcctcagccccctgagtagctgggactacaggcacaagccaccacactcggccaatttttgtattttttgtagagatggggtttcaccacgttggccaggctggtctcgaattcctgacctaaggggatccgcccatctagcctcccaaagtgctaggattatcggcatgagccattgcatccgacctgtccttactttttaatcataacagaccccaagacacatggccacatgggtaaaggagatggtggcgcatgcctgtaatcccagctactcgggaggctgagacaggagaattgcttgaacccaggaggcggagg[133 bp omitted]aaaaaaaaaaaactaaaaacaattaaaaaaaatcagggaacaggcagccttatctccacgtacctgtcctggggcacctcgccacccaccagctggaccacagtagggaacacgtccatcaggctcgtgggctctccaatcactcggccggccgggagcacccccggccagtggaagatcccgggcacgcggatcccaccttcccatcctcccatgcccttcccacctgtaagtagaagacatcgttaggattttgccggaaactgcccagtctgtacacacatctggatgtatttgtgcataggtatgtgaatacgcacagccacccggatgcacacatgcacactggggcagcctcagcttcccaaaaacagccacagcaatatttccagaatcatgctactccctggcctcttgaatatcggtgggtcgctgtggctgattcaactgttctagtcgatctatgctacctttatttagaataaaataatgtattaaaatattcattaaatttaataatttaaaaatgtttgttaactatcaataatttttaaaatatgtattattatgcatcaatattaattgatgcatttaaaatattaaaatagtaataaatttattaaatatttaaaaattaagactataataaaataaattttaattttatctgaattatttatttatacctctctgtattctactaaaatgtaaaccctttaaaggaaggggatgtgactttttatctgcctgtcctgctcatctaggtagaacttgtactacagtaggtgctcaatgcattctttttgaaatgagcaaactcattttcagttcaacttgttctgggaccctcagtggtggcagatatttggtcgaatgcatatgtgtccccgatgtccacaactcacctttgtaaattccgttccatccccctaactggctgtgtccatctcttgcctctaaatgtcctccatggtcagaggtgaaatacgtgaatgttgagttctttaaaccattgtcttcgatggcattaagaaccttacctttacagaaaatggaaagtttcaggaccaagaaaacaaagcagcatccactagttcaatgcgcttcttcctttctgcaggagacacctcttgccaggaagtcataagaagagaccacacttactcggaggccgtggttacaatgtgatcccaaagtgtaagacatagctaatcactgtgataccacaggactgtttacaatgcaaaccaacaataaaattcgaagccccccaaccgactgatggactctcccttcagccaaggccattccaaagttaacctgaaaaactaggtcaggccgggcctggcggctcacacctgtaatctcagcactttgggagcctgaggtgggtggatcacctgaggccaggagttcaagaccagcctggccattatggtgaaacctcatctctaccaaaaacacaaaaattaggcaggtgtggggggtgcacgcctgtaatcccagctacttgggaggctgaggcaggagaatcgcttgaacccaggaggcagaggttgcagtgaggtgagattacactactgcactccagcgagggtgacagagtgagactgtttcaaaaaaaacccaaaagagggccaggtgtggtggctcacgcctgtaatcccagcactttcggaggctgaggcgggtggattacgaggtcaggagattgagaccatcctggctaacaccgtgaagccccgtctctactaaaaacacaaaaaattagccaggcatggtggcgggagactgtagtcccagctacttgggaggctgaggcaggagaatggtgtgaacccaggaggcggagcttgcagtgagccgagatcgcaccactgcactccagcctgggcgacagggtgagactccatctcaaaaaaaaaaaaaaaagaaaaaaaaaaccaaaagaaacaaaaaacaaaaacaaggtcaggccatgttggaaagtagtgggggcggggggagtggtggacatgcgtcatgataccctcctccctttggaattcaggcacaactgaccagcattcacattgaaacagagacctatgactgagagaaggccaggcacagtggctcatgcctgtcatcccagcactttgggaggccgaggcaggaagatccattgagctcaggagttcaagaccagcctgggcaacatggtgaaaccctgtctctacaaaaaatacaaaaattagccaggtatggtggcacatgcttgtatgtagtcctagctactcgggaggccgaagtgggaggattgcctgagcctgggaggtcaaggctgcaatgagtcaagatcacaccatgcactccagcctgggcaacagagtgagaccctgtttaaaaaagaaaaaaaagactgatagaacagactctttaagtctgataagaaacatttaccatgtattctctctgaagcctgctacctggaggcttctttggcattatgaaaccttggcctccacaaccccttatcataacccagacattcccttctattgattctcagataataactcaaccacctgccaatcagaaaatctgtgaatccgcctttgacctggaagcccccctttcagtggtcttgcctttctgcactgaaccaaggtacgtcttacacgtgctgattgatgccgtatgtctccctaaatgtataaagctgagctgcatgccgaccaccttgagtacatgttctcaggacctcctgagggctgtgtcacaggccacttgtcactcatatttggctcagaataaatctctccaaatattttacggagtttgactctttcggtcgaccccaagataccaccaatacaaaacacagaatgaacacacaacgccaagaggttgccagtgagcacgcttttttaaacatagtgccgtgtgtgtgtgtcacataataaagacactggggagagggaaatggtgagactcagtgatgacagaaccctatgtaggaggaagcagggctgtaactagcatctatgggcattggcgtattggaggctgatggctcagcagcgcagaggacgccctgcaaaccaagcagttgctttatccctggaggccactggtcattgaaagcactgaaagtcaaaatgatataaaccacaaggtcatctgtagctctgaaaatgcagactttgaagcctgctgtaaactgaaaagtatctgaggcgggtctcaatccatttagaaagtttattttgccaaggttaagaatgacacagcctcaggaggccctgatgacatgtgcccaccgtggctggggcaaagcttggttttgtatactttagggagacatgagacatccatcgctacatgtaagatgtacattggttgagctggaaaggtggaacaactggaagtggggaatttaaacatattctcattggtaactgattgaaagagttatcaatagaaaggaatgtctgggttatgataaggagttgtggagaccaagcttttatcatgcagatgaagcctctaggtggcaggcttcagagaaaatagattgtaaatgtttcttatcagagttaaggtctgtgtggatgttcatgctgcggggggtagaatgaggcaagcccaaccccctcttcccgttatggcatgaaccagtctctcaggttaaattttagggtgccctggcaaaggagggaatccattcagatggttgtggggggccttcgaatttatttttggtttacactgtgaaccaatcccgccctatcactatgcttgtctcgggagatatgttcagattctgcaaggattttaatatctacactctcttaagaatctgcagcctcgttggtcctctccagggtttcttcaaggccatagaaggaaggtgacctctctgcattgtccgaactttattgctttagtttctgtaacttctaatgaggctgttaagtcattggctgtgtagaaggttgacaatatagtttggatgtgtgtccccgcccaaatctcatgtggaattgtcatcctcagaatcggcggtggggcctggggggaggtgactgaatgatggggacagagttctcatgaatggttgagcaccatcccccgcttggtgctgcggagggagtagcttctcacgagatctggttgtttaaaagtgtgcggctcttcctctcctctcttggtccttctcctgccacaagacgcctgctcccccttcgccttccaccatgagcaaaagctccccgaggtctccccagaagcagatgctgccatgcttcctgtgcagcctgcagaaccgtgagccaatccaacctcttttctttataaattacccagtctcaggtatttctttgcaagaatggactaatacagttgattttgtgcaaaattagactaagtaatcagaaatactgaaggaccaaataaatgatatgagagaagtttttctccctattcttcgtcttttatttctttttttttttggagacagggtcttgctatgtggcccaggctggagttcagtggtgcaataattatagctcattgcagcctcagcctcctgggctcaaatgatcttcccacctcagcctctggagtagctgggaccacaggtgcacaccaccatggctaattttttaaattttttgtagagatggggggggggggcgtctcactatgttgcccaggctggtcttgaactcctggtctcaagccatctccctgccttagcctcccaaaatgctgggattaaaggcatgagccaccttgccccacctgaaaatgcagacttttaagactgtgaactctatcacgatgcttgtctcaggagacacattcagattctgcaagaattttaatgtctatgctcttttaagaatctgcagcctcactggtcctctccagggtttcttgaaggccatagaaggaagacagcgtgtctgcattgtcctgaacattaactttatcgcttcactttcggtaacttctgatgatgacatgaagtcactggctgtgtagaaggttgattttgtgcagaattagaccaagtaattgggaatactgaagaagcaaataaatgatatgggagtgtgttctgcccccattctttgtactattattattattaaagagacagggtctcactctgttgcccagcctggagtacagcagtgcaatctcagttcactgcagccttgacttcccaggctcaagcgatcctcctgcctcagcctcccgagtacctgggactacaggcgtgtaccattatgcctggctaagcatttatttttgtagagatggggtctcactatgttgtgcaagctggttttgaattcctgacctcaagtgatctgtccatctgggcctcccaaagtgctaagagtaactcttattctttttctttttttttgagacggagtcttgatctttcacccaggctggagcacagtggtgcgatctcaactcactgcaacctctgcctcccgtgttaaagcgattcttgtaccttaacctcccgagtagctgggactacaggtgtgcaccaccacaccgggttagtttttgtatttttagtagagacagggtttcaccat[140 bp omitted]gccctatgttcaaacctgaggccgagggtggagtgaggctccatggtaccttgacttacctatgagccagtccatctcctccacattatcaccatataagccatgctgacttttccccaggaatgcactcgtggtcacaaggggaatgtgcacatgcagcaaagaaaggaagaggagaaatggcccatgcttgtgtctgaaagaagaaaacttccttgagaatacacagaatatacagtacaccaaagggacccctgcacccatacgttcactccagcactattcacaagagccaaggcaggggatcaccttctgagttcatcagtgggtgaacacagaaagaataaatggtgggccaggcgtggtggctcatgcttgtaatcccaacactttgggaggctgaggcgggaggatcacttgaggccaggagttcaaggccagcctgggcaacacggtgaaatgccatctctaccaaaaatagaaaaattagctgggcgtggtggcttgagtctgtggtcccagctacttgggaggccgaggtgggaggacggcttgagcccgggaggtggagcttgcagtcagccatgatcataccactgcactccagcatgggtgacagagccagaccctgtctcaaaaaaaaaaaaaaaaaaaaagaatatattgtatatgtccacaatggaatactattcagccataaaaaagaatggaggctgggcacagtggctcaagcctgtaatcccagcacttcgggaggctgagcctggcagctcagttgaggtcaggatttcaagaccagcctggccaacatggtgaaatggtgaaaccccatctctactaaaaataaaaaaattaacagggtggggtggcaggtgcctgtaatctcggccactcaagaggctgaggcacgagaattgcctgagccttggagacagaggttgcagtgagccatgatcacaccactgctctccagcatgggtgacagagccaacgctgtctcagaaaaaaaggttatatctggtatatgtacgtgatggaatactattcagccatcaaaaagaatgaaatcctgtcatttgcagcaatacagatgaaacaggaggtcactatgttaactaaaataagccaggcacagaatgaccaatactgcatgttgtcactcatatgggagagctaaaaaaaaatcgatcacatgaagatagagaatagaatgatagagaccagaggctgggaagggtgaaggacaaagagaagtggtttaaagagtacaaacatacagtaagcttaaaggagtacattcaacgtctgatagcagagtagggtgaccaaagctaacaaaatgtattgtactcaggagatggacactgtaagtatgctgtttgatcgttattcagtgtatacatgtaacaaaatttcacacataccccatacatttgtacaaattaaaaagtaagggccaggcacggtggctcacgcttataatcccagcactttggaaggcagaggtgggaggatggcttgagcccaggaattcaagaccagcttgggccatatagtgagacattgtctcaaaaaaaaaaaaaaaaaaaaatgagacattagaaaaaggccaggcacagtggctcacttctgtaatcttagccctttgggaggccaagatgggaggattgtttgagcccaggagtttgagaccagcctgggcaacatagtgagaccccatctctacaaagaatgcaaaaaaaaaagtttaaaaaactgtcaataaaaatgtacagaatccaatggcgtgtatgtcaatgctattcgagccatcacatgacatccacttcgagactctcatatgggaaacccagccacatgaaaaggttggcttctgcaaagccgtctcctccgagggttggtgtctgagatcccaaagattataaggggactctcagatgctctgagcagttaccgtgtcttttttttaaattaaactttatttttatttttttagcgacagagtctcactctgtcacccaggctgaagtacagtggtgtgatcattgcttactgcagcctcgacatccgaggctgaagcgaacctcccaccttagcctcctgagtagctggcattgcaggcacacaccactatgcccggctaatgattttatttattgtagaacctgtcttcctatgttgcccaagctagtctaaagcacctgggctaaaagatcctcccatcttggcctcccgaagtgctaggatgacaggcatgagccatcgcgtccggccccatctcctctttaagatgcgatggttgcttacctttcaatataggaaacagcttcctttagcataagactcgctgttttctccagaaccatgggttgctccgtgacgtcatggtttctcatcaggatacagttccagcgtcgcacaaacccgaaggaggagtaccaagagatgaaaaacaggcagcccacgccggccatgccggtgactgctctcgcggagacagagaagaaaccgcaggtctggccggcagccagggtgagaatccccagcgccaggaactgggtgtaaccccagagctgcgccctcagggcggcgtccacttcggggggcctgcctgggtcacagtcgtttgtgagcgtgaagggcatgccgtagaaatagtcaaatccgtggttcagggggtggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaaagtctgcaaagagcaaaactggaaatggaaaggcaatgaatggattggatacctgtgtttaaatgaacgcattctgatccgtgaagactaacgaatgcatccatgtcagaacccttggcaagtgattaaaggtttaagactttcggccgggcgcggtggctcacgcctgtaatcccagccctttgggaggccgaggcgggcggatcacgaggtcaggaaatcgagaccatcctggctaacacggtgaaaccccgtccctactaaaaaaatacaatacaggtggcgggcgcctgtagtcccagctactcgggaggctgaggcaggagaatggcgtgaacctgggaggcggagcttacagtgagccgagatcatgccactgcactccagcctgggcgacagagccagactccgtctcaaaaaacaaaaatgaaaataaaagtaaaaattaaaaaaagtgagagagaaagaaagaataaatccaccctcagagtaggagacacacagacttctacagtataaagcactggccctgtaatcccagcactctgggaggccaaggtaggtggatcacttgaggtcaggagttcgagaccagcctggccaacatgctgaaaccctggctctactaaaaatgcaaaaaaaattagccaggcatggtggcacatgtctgtggtcccagctactcaggaggctgaagcaggagaatcgcttgaacccaggaggtggaggctgcagtgagttgcaatcgtgccactgcactccagtgtaggggacagagcaacactccatctcaaaaaaataaaaataaataataaataaaagaagaaaaaactttaaaaaaattcaaaataaaaataaagtggcaggaaacttgaaaaggaggaacaatggttgtcctttagaaaaccacagcttcggacaagttagggtgttgcggctcctgtgaatgggacagtggctttgagtgtgagaaaagcacagaggggaactggggaccctgcacagagatcccaccaccaggtcggggcgggtggcctcaccactgcgctcccacgttctcatgtgtatgacggggacagcacctctaaacacacaggctgggtaaggaatgaaggaggtaaccagcagactgcctggtgcttggcggcataaaccaacatctccctcctttcctctccgtgcagaaaggagtttaaggggcaggcctgagctagtgccccttacaaaggctggcttgtaagattccccgtggctggtgtttgagatctggatttccaatggagaagtcacaccattaaaataataagctgactgtgcctaaactatatgcaaaagcaacgtggttcatgctaaacacctcctttggttctgggagtctggaattcgggtgggtgccaggcagtgagtgcctgcaggaccagcccccaacagaaacccctgggcactgattctcccgggagcttccctaatagacagcattccttgcgtgttgttgaaactcatttctggaggaatatggtgcatcctgtgtgatcccactgggggaggattcttgggagcttgtgtctggtttgccctgggcttcattccgtgtaattcccatcactgattctgcctcacctcctttgactgtcataaatcacccatgagcacaactgcatgccaaatcctcctagcaacttcctgaacttaagggtgctcttggagacccctgacatgctgtctgttataaagagggtgttctgcccctgccggggtttattgtctaaaggaaggcagtgtttgttaactctggggcttttgagatggtgagtggccatgtagagaaggataatgtctgaagaaggtcgtgataaatggggacaagctgaagactgataggtccagagaagaaaagagggcaatctcctaggattttgaatttaagaagaaaaaaaaactcatgaaaaactggggacaatccaataggcatgagatggaccaggcaccaacttctgattcagaggacacaggattgttttcctttgcaggaaaacgggatctttttttttttttttattctttgagacagagtctcgctttgtcacctagactggagtgcagtggtgtgatctcggctccctgcaacctccgcttcccgggttcaagcgattctcctgcctcagcctcctaagtagctgggactacaggcgtgcgccaccacgcctggcctgggatcttttttatcacgaatattcccaaccaccgtataatgtgaggctcccacatatccacacctatgaggccggttgcatagccatgctgctgcaagattcttgcaaaagtggtttcgttctcagggagtccacctgagcctgcgttccactgaagggcccggtatccattgctggcgtccatgcctgtggggcagagaagacaggaagaatttactttcctttctctagaggagcacttctcaaccagagggatttggtgtctgagatctggatttgtgcacccgagccaggctgctattatctatcatccatctatcatgtatggagctatcaattatctacccatctatcgtctgtcatctatctacctacctacatacctacctacctaccgacctatcacactattctcgaaataataagcatggccaatgtctggagatgtttgtggtgtcacagctcagaaagggtggtgtgtggtgctactcgtatcgggtgcgtggagccgagtgatgctgctcaagaccctacatacagtgcacagaacagccccaccacagagaatcatctagccccaaatgtccctcatgccaaaacagagacaccccaccttaggatgacagacgccatgtgatctatcatatgtctatctatctgtttacctagctatcacctgtcacctgtctatctcaatatggatccatcatctatcatctatatctatccatctatctatgtatctattatctgtcattatcattaatcatctagctatcaatcagctatcattatctatcatctgtctatcacttatctttctatcatcattatctatcatctatcattatctatcaatcatctcttatctagctatctagctatcaatcatctatcacgtcatgatcaatcatctatcattatgtatcatcatcatctagatatctagctatcaatcatccattatctatcattatcatccatctagcatgtatctagctgtcaatttatctatctatctatctatcatctatcatctatctatatcacaatgattctcaacttggggaaactttgctctctctaagagacacttggtcttgtgatcagtcatactggctcggaataaacctctttaaaatattccacagaccttggtttttctgttcacatcctaatgatcacaacttttatgtgtatgcacacaatacaatattccttacataaatacaaggaagacgatgaattgcaggtgatctttgtaccattgcccctgtatcttcaccatcagtactcaactgttacagatgacagaatgagtgcacacagatgtacccatttctccatcatctccgtgacaccaacctgatctgaaggaatgtctccctgtgaggaatgcagctcggcttggggtgcagagcggggcggccgccaggtgctgagtgagcctcacaccttcctctgcaagctggtcaatattcggcgttctgagcaaagcacacaaatgtcattgttggaagggagacatgcatttggcttaagcagatccctgctctgaaaggcacaggaatagctgcaaggacttcaccggatttcagaattagttgcattatggtctcctgcagcggtagattgaccccatcctaagtttggtgttgatgttgagatggatgacatctctctctctctctctctctctcacacacacacacacacacaaagtatatgagacaatttatgactcatataacgaggctttctggggagagcagggcaggccttccaagctcatgtgaaataaggaagcaaggaaaggagatttatgttttcaattgtggtgagggtgtggggccgagatgagggttcccatgcaagggtgggggcgtttatggtctgaatctgccatcagcaccaaaggagacagtccctgtgctttcttatctgcttgtccagatggggaacacagacagaagaggcttaaaagctttcatcatcagatatcaaaaaactgtgagggccgggcacggtggctcacgcccgtaatctcaactctttgggaggcctaggcgggcagatcacttgaggtcaggagttcaagacaaacctagccaacatggtaaaaccccgtctctactaaaaaaaatacaaaaattagtcaggcaaggtggtgcacacctgtaatcccagctactcgggaggctgagacaggagaatcgcttgagcccaggaggcggaggttgcagtaagcc[131 bp omitted]aaagaggtatccacatagaatggaatctatggaatatgactcagccactgcaaggcgtgaggcacggtactgtgaaagcctcctgacataaaagaccacaggttacataattccatctgtatgaaatgtccctaacaggggaatctatagagatggaaagtatattagtggctgccagaggctgagggttagggtgctgagagagttggaggagtgttagctggggctgccataacaaagtcctacacacctggccgcttcaacaccagatattggttgggcacggtggttcacgcctgtcatcccagcactttggggggctaaggtgggtggatcacttgaggccaggagttcgagacaagccttggcaacatagtgaaaacctgtctctacaaaaaatacaaaaattagctgggcgtggtggcatgtgcctgtagtctcagctactcaggaggctgaggtgagagcctaggagatggaggttgcagtgagctgtgatcatgccactgcattccagcctgggcaacagagtgagaccctgtctcaaaaaacaaaacaaaataaaacagaaaaacaaacccagtagacatttattctctcacatttctgggagctggaagtctgagatcaagcatgggcagggctggttcctcctgaggccaccaccctgggctcgtagacaccatcttctccctgtgtcctcaggtggtcattgctctgtgtgtgtctgtgtcctcatctcctcttcttataaggaccccagtcctattggatcagggcccaccctagtgacctcattttacctgaatcacgtctctaaagactcagtctccaaatagagtcacagtctgaggtcctgggggtcaggacttcgacgtaggcgtttaggggacacagattcgctcctcgctggaggtgatggctaaggggatgcagagtttctttgggggtatgcaaatgctctaacatggtttgtggtgacagatgcacagctccatgaatagaataaaagtccctgaactgtacactgtaaacagatgaaccgcatgttctgtgaattacaaccaggcctgctcagggtgttcgaaaggggatccctggacagggggcagattgattgattgattgacttagagacagggtcttgctctgtggcccaggctagaatgcagtggcgcaacctcagctcaccataacctccacctcccgggctcaagccatcctccactctcagcttcctgagtagctgggactacaggcatgcgccaccacacctggctaattttttgtatgtttcatagagacagggttttgccatgttgcccaagctggtctcaaactcctgggctcaagtgatccaccttccttggcctcccaaaatgctgggatgacaggcgggagccaccgtgcccggcccacacagggcagactgctgcaggtgctgcaatgttcactgcaaagaagggaggccctgctctgcggggaccgctcctgaggttggcagctattgaaaagcagatgcagcctgcattctggggcggtccttctaggagaaaagcccaccaaatggaataaggagctttctcaccttttctcctgttgcagaaagcacgtgagcaccactcaagcgctctgctggtaaggttggcatagaggctactactctgtgtttgcacatgccactgcagtgggctgaatgggggtctgcgaaccgatctgtccacgtgctgaccccccaaacctgtgtgtgagaccttgcttagaaaaactgtctttggagttgttattaggtatcccgagatgagatcatcctggtttagagagggccccagatgcaatggccagtgtccttctgagagacagaggaggagacacagacacaggggagaaggccgcatggggacggaggcacaaactggagtgatgtggccacaaagccagagatgcctggagcccccaggagctgggagaggcaggaagggtcctcccctacagcctctcagggagctctgttggtgtcttaatctcctcttttagtaatccatatcagattagggctcaccctaaggacctcagtttaacttaattacctcttcaaagaccccatctctgaaaacggtcacaccctgaagtaccggcggttagggcttcaacctacaaatttggaggaggccagaatttggcccacaacagacgttgtttgcaaacgtcatcaacagaagatgagatctttacagcgggcaggccttgctgcaatggccggtgtccttataggatgaggagattaggacacagacgcagaggagaaggccccgtggagacggaggcagagactggagtgatgtggccacaagctcagggacacctggagcccccaggagctgggaaagtccggaaggatcctcccatagggcccccagagggagcccggccctgcccacacctggatttaagatttctggtctccagacctgggagaacaaatttccgttgttttaagctacccattttgtggtagtaatacattcaccccctcaccgcagttccgcatggtttaaaagggcctttttacctgttggtagttttttgttgagttctgaggccctaaggagtttcctaatttctccaggcagattttaaatgcaccattccgtcaaactcacataacatcatcaccaatagcaacaaccaactgtacctcagtgtattgttcccgtagcaaccgagatccccagtgcctagatcatccgccatgatcagtaggatatttggtttaaaggcatttgcagttttaggttcacacgtcttcagaagcaagcataaaaacagtagcaccggcaaagagtccctggagagaaaagcgaaacacagaaatgactatctacaatttggcaagggaagtaggcatttcaaggcagctcgctgggaaggcgaaggtcttaccactaaattaagacgttcagctttatgggaggttattgtcttggcctgaattcctgcactggtgtccctgggccaaaccgagggtcagactgctatttcttgtgacccaatagcgagatgcagatgaattgggaaagaagagagtttttaattctgtaaccagttacaggaggaaggcctggaaattctctcccaaccaactcaaaattacaaagctttccagagcttatataccttcaaagctatatgtctaagtgtaagtgtgcatttatctaaagacataagtgattaacttcttctaatctgtaattaagatctgagtcctgaagaccttcctctggagcctcggtgaattgacttaatctagatgggtccaggtgctggggtgattacccttatcttgtctcctgctaaatcacagagttctggggagttcctttagtccccaacaaagcttgtttgtggaggtctggggagtttcttcagacccacaataaaacttgtttaatcctaaatgggtcctgttaagaattccttcgttatcttgtcatgcttcaaaggcccaggagaggcctgggcagaactcttggtgtgcttttgttacatcccagcctgtgcataaaggcgctggttgtttcagcttttagtatgtaacttcacactcagtcagtgctgaaacagttgttacggaggcctgcattagtgagacctggcctgccacactagaccatacaggtcagaacaaactggaatggagtcacttgtgttaactgccacatcgtcaagctgaacagggaaacaggtcagttttccaaaaaacagaagatttgagtaagcaagaagaagatgtgtagttcatctgagctaacaaagtctcccgtgctttaaccctgtaagaaaagtaactttgaaacaaccaatctgctttattattcttttttttcttttttttgagatggggtcttgctgtgctgcccaggctgtagtggcatgatggtggcttacagcaacctctgcctgattctgaggtgggaggattgattcaagcagtccttgaactgcagtggataggtggtgtcttagtgttgggggatcgtggctgtgctctccggggaggacgcgaacgaggggtgtgtctcagggtgtgtgaggggacacggctctactggggggcaggggaggaataaggccatggggagggatccggtgtggccagcagggcaatggccgcggaaggggacaggacggggcgtgtcttggagggtggcgagaggcacggcagtgctgctgaggcaggagaatagggtctggaggcagggaacctaaggctttccatgccgacttcctagaagtaaattgaaaggaaaatcctaactttccttttttttttaattttaatttttattattattttttgagatggagtttcactcttgtcgcccaggctgcagttcaatggcatgatccgggctcactgcaacctccacctccagggttcaagcgattctcctgtctcagcctcctgagtagctgggatcacaggtgcctgccaccacgcccggctaatttttttgtaattttagtagaggcccggcctaatttttgtatttttagtagagacgggatttcac[131 bp omitted]caaaaggaccgaaggcttccctttgaccttttctattgggtagatagtagactggctgtctgcaaccaatcggactgatttcgggtctagtcttcgtgtgcaactttgtgacttcaccctagtctctgattagttgggttttgcaaccaatcagatgtttgcacaggagtgtgacctttgtaacttcaccctttggttggctgctgcctgcaaccaatcagactgatcgcgggccaccacttcagttacatgaggtgagcatgaagtggccaatgggaaacttctagggggtatttggacccaagaagattatgtacccgggcccttgagccgctgcttggtcggctcccacactgtgacgtgtccttttgttttcaataaatccctgctttccttcttttgttgcttcattctttctttgctgggcgttttgtccaattctttgttcaaaacgccaagaacctggacaacttgcagtcacgaccctctaccggtggcactggggcgcaaatgaagctgggaatgcaggacccggcgcatctgaggaagtgcagcggggcatggcggtgctagagggtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagcccacgggggggaaaggggcgtgtcttaccgagcgtgttgggggagtcacagccgtgcttgggaggatggggtctgggggaaggacggggcgcgtcttagtgggatgagggggagggcacagccgtgctgggaaggcaaagggccggggggcgggatggagcatgtcatggtggggccgaagaggcggggggcgggaaggggccttcttagaaatcgggagggcgtcacagctgtgctcgggaggacggggcgttggggagggacagggagcgtcttagtggacccggggaacacggccgtgctggaaggcatcgagctggggggttgggggcgggacggggtgcctcttaggaagtggggcgggcaaggctacgcttcgggggatggagccttggggcgggacggggcgcgtcttagtggggcagagcggggggcgcggttcggggcgggtcttagggagcctttgaaggccgaatccgggcagcggtgtagctgggcgtggaaggcggaggacccagcagggcgtgaccggcccagtttccgctccctccgggtcccggccagccttcctccgccctcccttcccttcctcctttgttctctttccctgcccttccgccttcccttcagttcggtctcctccacccgcccttcgtcccctcagtcgccccccatccctgggctctgctgtctggcgtctttcccgggcacagaacgcgcctccagctacattttggagactacaaggcgccggacacaaccacgccctttacaggggcccaggctcgcccggggcgcccctcgccgtgctcgcgaccccctccccaggcccccaccctaggccttagtatgggccgcgtcccggggtcccaggcacctggcggcgggcgcggcgcgtcccctccgcgcggcggatcgcatggccgagcgctggcccagagcgcaggaccttgccctgcgcactccgcgcccgggcgccgctagtgccaaggcttccgccctctcagctgcgggatctgggccgggcgcccgcccctccttcatccgcgtcatctcctggctctcgggacctccgggacctgcgcgtggaaacaggttttcccaggtcgtcacacgggaaggcctgggctaaggagctgattaaacccagttacgattgaccgggcgcggtggctcccgcctggaatcccagcagtttgggaggcca[134 bp omitted]gaagcaggagagttgcttgaacccgggaggtggaggttgcagtgagctgagatcgcgccactgcaactccagcctgggcgacagagtgacactccgtctcaaaaaataaataaataaaaataaaaaataaacccagttaggcttgagcacagggagccccttttctttttgtcaggaagggtcttaggacctacccagagcaatcaagttgcgatttcagtttctcaaagcttggtgtttgaaatgtctgttccggatgctggacttgtactctaagtctgggacggggaatgctagatgggccctttttttttgcttttattactattattattattattttgagatagggactcactctgtcgcccaggctggagtgcagtggtgcgatctcggctcagtgcaacctccgtctcctgggttcaagcgattctcctgcctcagcctcccgagtagctgggactacaggcgcgtgccaccacgcccggctaattccaattgctatttttatctttgtttctttcatcagactgctgttgaaattactccttttgattaatcactgtgccctggacccctccccatcttttctgtgactcatccttttgtttttgaatgatgctattttgctcattaccctctcacgtaatgctttttttgtatctttggctctccctttgttgtttgtttgttttgtttttaactcttttgacctctagaaagatcaaggctgagagttgaggctgcagtgagcctttgtttttgtctaactctcttgacctccagtcgctgattctctcaagccccttcatgtcttacctcatcccctcacatcccctcacaatgcaagatctggtcaaagtataaattcatattttgtaggaaatgctagcttacaaaacaatatcacatccctacctccagcccaggtgacccactttccctcaaagggggttgcttaggtcctcttccactggtcagggacaaaatgattccatagtcttcaagattaacagtactttctttttccaaggctgaggctgtcaagggtgaggctgtcaccgcctcccaaggaagtggaactaccggtgtgcaccaccacccctgacacatttttgttaatttatttttttgctagagactaggtcccactatgttgcctaagctggtctcaaactcttgcctcaagcagtcctcctgctttggcctcccaaagtactgggattacaggtgagccactgtgcctgaccagccacaagactctatgttgggtgtgtaggtgggaagcatatccaggtcctcctcaccattattctgcctccaacatttatgccatttttttttcctttgcaactcagttctctatgcttaccaaatggaatcagtaaggtaggggaggcggggtggaagtttgtgttgaaaacatagattcagaagcccctccttaaattcactgagttaggattttcataaatgagggagctgccccacactcccctgggatgagatgatgggggtgcttgttcaagacaatacagtcaggagccctactccctaaatttattcaattggaatctcccaaaatggtgctgggaattctatttagaaaaaagaccattcacttttaattggcaaatttagttcatttacatttattacgctggccatctgtctggagctagctcttgagcactgtttattgcttctctctttgccctgttactctgaaatagcttttatcagacaggcttggtggctcacacctgtaatcccagcactttgggagactgagggggaaggattgcttgaaaccaggagtttgagaacagcctgcgaaacacagagagaccctgtctctacaaaaaaatttttttaagttagccgggcatggtggtgtgcctgtagtcccagctatttgggaggctgaggtgggagagtcatctgagtgcaggaatttgaggttgcagtgagctgattgcaccgttgcactccagactgggtgacagagcaagaccctgtctctaaaaaaatttaaaaaagaacttttttatctttgagggcttcccaactgggattccttgctgagcctctgtcatgcagatggagaaggccaggccgaggcctggaaggaggggggcaggagacagcccagaagcagttctgcaaggaggtttagcaggggtggcgcggagatttgatccttggaagaaatcctatgctgctgggagttgagattcctgagaactagagagaaaagaactttgggtgcccttaggtaaattatgtaaacacactgagctgtcttgggtgcccaggatttggaaatggggcctgggggcagtaggagctggtgctccagaagtcatatttgcgggaggttgtggggatggaaagggtgggtaagccctgaccctgagggtctcacatgactttcagcacatggagcctccatggggactttggcttcaaagccatcaagctcaagagtgtgggcaagtgtggagacagaggtgactctccccagtggatgctgaagaacttaaaggtgactctgtgggccgggaacatcgggcacagctgacccaaagtgctggtcttgttccataagccatggctatggggaaagccataggggttaactggttcttcctgccatccctccctccctttcttcctttttctttttgcttctttgctttccttccttcctgccattttttccttcctttctttttagagatgaggtctcgccctgtcgcccagtggcacgatcacagctcagtgtagccttggacactttgggaggccaaaggctcaagtgatcctcccgcctcagcctcccaagtaggtgggactataggcacgtgtcaccacacctaattatttaaatgttatgcggaggcagggtctcgctatgtcaccccagctggtctgaaactcctggcctcaagccatcttagtgccctaaagtgctgggactacagatgtgagtcaccgcacctggcctactatttctttcttgacccaagagaattggctggagatggatttgactttttggtctgtatgcacagcctgaattcttggaggctgatgtggattggataatttgaggacatgttcttgaggcggtgacaaggtggggcattgctcgtcacatacctaggcttggaagagtgggaggagggacctgttgcttgaatctggagacagaaagagctattggaaagacctccttactcccaggggagaatgtgctggggactgaattgtgttgccttcaaactcacaggaataaggtttttattcatcctttaaaatgaggtcacaagagtgggccctattccaataggagtggggtccttataagaagaggagattagggccgggtgcagtgactcacgcctgtaatctcagcactttgggaggccaaggtgggcggatcacttgaggtcgggagttctagaccagcctgggcaacatggtgaaaacccacctctactaaataatacaaaaattagccgggcatggtggtgcacgcctgtagtcccacctactcgggaggctgagacaggggaatcacttgaacctgtggcagaggttgcagtgagctgagatcacgccattgcactccagcctgggcaacagagcaagaccccatctcaaaaaaaaacaaaaaacaaaaaacaagaatcagagataggacacagacaggcacagagggatgaccgtgtgaagacatgggaagaaggcagcagctgtgaaccgagaaacaggttctccccagacacagcttccgtcacgccgtggtcttggacatccagcctctagaactgcaagaaagaaatattcttgatgatacccagtttatggtattttcattctagcagcccagacaattaaggcgcagcctgattatgcaatgaccttgcagctcagagctggggcgaacacttcctgcacagcgcggcttccacagccagagtttgcccaaatcacctggggcattggagacaaaggaaaaccacttgaaaacagttccaacgggaagcacggctcatccttgtggccgtaaacgataaacaaacactataaatgggcaccacagacaaagccacatcagtgccagtttttatctttggggcctatctcctgttcatgtgcaaacctgtaggtcacagagacacctttgctgggacttgtgctgttttgggctacagggcagcctcttccagactgagctggggtccattgacagactcctccccgactgcaggagatactttgcctctccagtttggtgtctgagtgatcattcaacggtgcattattaatgtttgtttgtttatttatttatttttgatgagacagtcttgctctgtcacccaggctggggtgcagtggtacgacctcagctcactgcaacctctgcctcccggcttcaagcaattcttctgcctcagcctcctgagtagctggcattataggcgtgtgccaccacacctggctgctgctgctgcttttttttttttttttttttttgatagagacagggtttcaccatgttggtcgggctggtctcgaactcctgacctcaagtgatctgcctgcctctgtctcccaaagtgccgggattacaggcgtgagccactgcgcctggccagtgtttattgttcatttctactttctcttgccttttcctttgtttttcacagggggaaactattcatccttatgcaaatagatatcttaacatgacactgaagtttgtttcatttttttgttttctttcttttttgagacagggtcttgctctgttgcccaggctggggtgcagtggtacaatcatagctcagtacagcctccaactccggtgctcaaatgatcctcctgccttagcctcctgagaagctagaactacaggcgtgtgccaccatgcaggctaattttttttttatttttgttttgtagagctagagtttcatcatgttgcccaggttggttttgatcacgggagtgatcctcctgtggtggcctcctaaagtgctgggatgacaaccaccatggccagctggtttgtttcaatttgagtgacaaaatttaggaatcggggctccagcttttcactgcagacatttattgtgggtcatcttccctaaggcaccagcagagggggaacgggccacagcagggctgcagccacggtctccagatgttgcccagcctgtccagctgcagaggaactgggctgagtgtccgctggtgttcccacaccgcctgctggactcgttccatcacctgatagaacacgggctctgaggctggtgtgaggatgtgggtctcagaagggtctcttgagaggtcaaagagcaaaggtggatcgtggtggactactttttccccaaagcacgggcagacctttcttccatagcaggcaccggctccctctggctggaacacaggcgtcacaaagtggactttccacattgttcctcctggtggaaagataatcattacagagttggcatagagaaatagggtgccttgctggagaatggcatcttcatagggctaaaaggtaggcctaacccaagcgtccatcgatggatggacagataaacaaaacatggtacatcttacatggcatactctgcagctatgagaaggaatgacacaatgacacaggctgcaacatcaacgaactttcaaaatactacgctcagagaaagaagttacaaaagagcacacattgcatgattccattcacattgaatgtcaaggatagggaaacacataatgacaggaagtagagtagtggtttccagggtctgcagggtgtgaaatggagagtgactgctgataggaacagtgtctgcttttggcgtgatgaaaatgttctggagctacatagacgtggaggttgcacaacactgtgaaagcacgaagtgcctgtgaattgcactcagtcagttttttcttttcttttcttttcttttctttttttttttttttatttgagacagagtcttgctctgtcgcccaggctagagtgcagtggtgcaacctccgcctcctgggttcaagtgattctcctgcctcagcctcacaagtagctgggattacaggagtgcgcctgtaattgttcacaaagaagatgaagtcgtgttaaggtcaggtgattaaaacatttggaagcacatctagatgcataaaatagactacaaaaggctgggcgtggtggctcacacctgcaatttcagcattttgggaggccaagatgggtggattgcttgagcccaggagttgcctgggcaacatactgagaccttgtttcaacttaataaagaaaaattggagaccaggcgtggtggctcatgcctgtcatcccagcactttgggaggccgaggagggtggatcacttgaggccaggggttcaagaacagcttgcccaacatggtgaaaccccatctctactaaaaatacaagaaattagccaggtgtagtggtgggcacctgtaatcccagctactcaggaggctgaggcaggagaatcacttgaacccgggagactgcagttgcactccagcctgagcgacaaagactagtctcaaaaaaataattacaaaaaaataagaaaaaaaagagactagaaaagtcttgaacacatgtgtgtgcaagcatgtgtgcgtgcgtgtgtgtatgcatgcacatacgtgtgtgtgatgatgataaaagttgcacttcatatagtgcagggaagaaagaatgaaatatagcccatacatggtgctgaaactataggtaacgactccccatcgttttaagacgattggcaggtgatctcagaaggcatgtcgctggaatgagagggacacatattgacaaaaactaaatttaaaaagctcgtggagaaaaacggaagtgcggagacatggagatggactctggaatgcagctccatccctagcctgttctagggcatggtgctttcctgcacagagggactctttccctaagggtgttaggaaggggctcccctactcactgtcccgttgatgccacctggctgcgtgcagaaacctctcacaataatgcatcaggaactcgtggtctgagtgttgggctgtccccaggagcaagggcagaaggtcttggccgtcaatcactctgcaggaaggaacatggcatggctcagggttggaacagggactctggacatttgtccctccagcatccaccagtcccagccccaggtggtgcactctccttatgttgtatcagtggagggaaagtctgggtgtgaacgcagatggatggaaggcatgtgtgtgcattagcacgcttagaagaagaatgcagcagctgcccacgttagtcaccaccaaacgtcacctttggctaaaaagtaattaattggccaggcacagtggctcgtgcgtgtaatcccagcactttgggaggtcgaggcgggtggatcacctgaggtcaggaattcgggatcagcctggccaacatggtgaaaccccgtctcaactaaaaacacaaaaattagccaggtgtgctggtgtgtgcctgtaatcccagctactcgggaggctgaggcaggaggatcgcttgaacccaggaggcggaggttgcagtgagcctagatcgcaccactgcactccagcctgggcaactgagtgagactcagtctcaaaaaaaaaaaaagaagaaaaaaaagctgaaagagccagcacccaaaggctggaatgtaacaaaagcccactaagagttctacccaggcctttcctggaccttgaagcgcgataaaataatgaagggattcttaacaggacccatttaggattaaacaagttttattggggatctgaaggaactccccagacctccacaaacaagttttattggggggtctaaaagaactccccaaacctccatgatttagcaggagacaagataagggtaatcaccccagcacctggaaccatctagattaagtcaacttactgaggctccagaggaaggtcctcaggactcagaccttagttctagatgaaaggaagttgaatcacttatgtctttagatggatgcacgcttacatgtggacatacagcttagaaggtatagaagctctggaaaactttgtaattttgagttggtctagtgatcatttccagccttctccccgtatctggttacagaaataaaactcctttctttcctcgttcatttgcatctcgttattgggccatgagaataagcagcccgaccctcggtttggtcggggaacaatttcagggacgccttactgcaaagccaaagtgacatgttcatttgccataagtgttgctgtgtctgtgcaaagctgaattgtttctttgggttgttctgtacctgtcctggggcacctcgccgcccgccagccggaccacggtggggaacacgtccatcagactcgtgggctcgccaatcactcggccggccgggagcaccccgggccagcggaagatcccgggcacgcggatcccaccttcccatcctcccatgcccttcccacctgggtttgaacagaaacaaaagaaagtggttaaaaaccagaaatagatgctcagcctggctgatttaacttttctgcttgtttcacttgtttgaagtttctctctccctgagtctctcaatttctctctctctctctctctgttttagtgacattaaaacattcaatctcatgtagttcccctgtagaggtttgattttatattttttattaaccttgttattggttagtgtgcattggattaagttaggtccttcactacaaatgactcttgttcttagaagacacagacacagaggagaaggccatgtggagacggaggcaaagactggagtgatgtggccacaagcccagggactcctggaacccccaggcgctgggagcagcaggaaggatcctcccctagagcctcaagaagaaagtggatacaactataacgtattgaacagtgaccccaaaacatgttcatgtcatatctcccagagcctataaatgagactttatttggaaatagggggtttgcagatataatcaagttaaggaccttgagataatcctggattagggtggccctaaatgcaatgacagatgtccttctaagagacagaagaggagacacggacacagagaagaaggtcacgtggagacagaggcagagactggagtgatgcggccacaagcccagggatgcctggagcccccggtaactgggagaggcaggaaggagcctcccctagagcatccagaaagaagtggattcaattgcaatggattgcactttagtcctcctgaaacatatatccacaccctgatccccagattctgtgaatgggaccttattttaaaaaggggtccttgtagatgcaattaagtatctcaagatcgtcgcggagaaggatggactctaagtccaatgacagcattctaagagacagaagaggagacacagacacagaggagaaggccacatagagacggaggcagagactggagtgatgtggccacaagctcagggacacctggggcccccaggagttggcagaggcagggaggagcctcccctagagcttctggcgggaacatttccctgagacacgttgatctcaaactcctggtctccagggctgggacaggataaattcctgttgtttaaagctccgccagtttataatactgacattcttgatggcacagagaaccagattgggtagaggatacattaacgtcaatggcaatgagataaagaaggtttctgaggagtcaggccttcaatgtgaagttgttgtgggaaggcattagtggatgtagttggcatttatatatcccgttttacatatgtactagactgatggatccatctacttcaaagcaaatatacatcataggtatatttgccaatattagcctaaaaaggctctttcaaggactgaaaaataaagctctctaagcagggagaagacaaaatgtgtaagcacaacagtgtgaagtcatgtacacggggcagcacattttagcatctttgtggtacacgaaagaatggcgtgtttggaaacaatg[136 bp omitted]accttcacctcccaggttcaagcaattctcctgcctcagcctcctcagctgggattacaggcgtgcaccaccacgcctggctaatttttgtatttttagtagagatgaggtttcaccatgttggccaggctggtctcaaactcctgacctcaagtgatctgcctgcctcggtctcccaaagtgctgggattacaggtgagagccactgcgcctggccttatccttcttggatgcattgtctgaaggtaaaattcaaacctgagtccacacaatggaatatattcagccatggaaaggaatgaaacatttccacaacacagatgaacctcagaggcatcatgctaagtaaaaacaaaaaaactccacatattgcatgatttcatttacataaatgtctagagtaggaaaatatacaatgatacaaaataattttgtggccaggcatggtggctcacgcctggaatcccagcactttgggaggcccagctgggaggactgcttgagttcaggagtttcagaccagcctgggcaacataacaagaccctatctttacaaaagataattttaaaaattaaataataaacaaatcaaaaataagtttttgggtgatggatgttagcacgggggaaaagggagtgactgctatgagtagaggatttttttgtgaggtgatgaaatgttctgaaataaacagtggtggaccacatgtggtggctcatgcctgctgtcatcccagcaccttgggatgccaacgtgggaggatcacttgaggtgaggagtttgagaccagcctgggcaacatggcaaaaccccatctctacaaaaatacaaaaattagccaggagtggttgcatgcacctgtagtcccagctacttatgatcgctgagacaggaggatcacttgagcccaggaggcaaaggttgcggtgagccaagatcgtaccactgtactccagcctgggagatagagccagactgtctcaataaaaataaataaaaataataacaataaattttacgaatgaaaatagtgattgtaaaacaaaaataaaattctaaggacccccaaccatctgaatggacttcctcctcacccagagctctttaaaaacttaacctgagaggctgtttcaggccgtgacaggaagcgggagtcgaacatgcctcatgattcctctctggcattaacatccacacagcctttaggtctgataagaagcatgttacaacctcttgtctctgaagcctagtacctgaaggcttcctctgcaaataagaacttgggtgtccacaatctttttttttttttttttttttttttgagatggagtttcgctttgtcgcccaggctggagtacagtggcacagtcttggctcactgcaacctccgcctcccaggttcaacggattctcctgcctcagcctcccaagtagctgggattacaggcacgcaccaccacacccagctaatttttgtatttttagtagagacagagtttcaccatgttggccaggctggtctcgaactcctaacctcaagtgatccacccgccttggcctcccaaagcgttgggattacaagtgtgagccactgtgcctggcctccacaatcctttatcttaacccagacattcctttctgttgatcccaggtctttagagaaacaacgaattgtcaaccaggaaatgtttaaatctacctgtaggctggaagccccgtggctttgagttgtcccacctttctggaccaaaccaatgtgtctcttaaatgtatttgattgctgtctcatgcctccctaaaatgtataaaaccaagctgcgccttgaccatcttgggcacacgttctcgggacctcctgagggctgtgtcacaggccatggtcactcctatttggctcagaataaacctcttcaaatgttttacagagtttagctcttttcatcgacatgatgatggttacacaactctgataatctactaaaaattccttaattgtgcacaaaaacgtggcaggccacgtctcactaacacaggcctccgtaacaactgtttcagcactgacgagtggtgaagttaaatagcaaaagctgaaacaaccagcgcctgtatacaaaggccgggatgtcacaaaagccccccaggagttctgcccaggcctctcctgggccttgaagcgtgacaagataaccaaggaattcttagcaggacccttttaggattaaacaagttttattagaggtctgaaacaactccccagacctccgcgatttagcaggagacaaggtaagggtaatcagccctggcacctggacccatttatttatttgtttatttatttattttattatttttgttgttgagatggagactctctctattgcttaggctggagtgcagtggcgcgatctcagctcactgcaacctccgcctcccaggttcaagcgattcttctgcctcagcctcctgagtagctgggactacaggcgtgtgccaccatgcccggctaatttttgtatttttagtagaggcgaggtttcaccatgttggccaggttggcctcaaattcctgacttcaggtgatccacgcacctcggcttcccaaagtgctgggattacaggcatgaaccaccgtgcccggccacctggacccatttagattaagtcaatttacttagtctccagaggagggtctccgggactcagaccttagttacagattagaagaagttcatcactaatgtctttagatgagtgcacacttacacgcagacatacagcttagaaatagaagctctggagaactttgtaattttgagttggtctggcaacaatttccagacctccctgtaaccggttacagaaataaactccctcctctcccagttcatctgcatctcatttttgaaccaccagaataagcagcctgaccctcagtttggtccaggaacaaaaattcaaactggagtatgtcaaattaccacttttgccctggataggaaaaatcactgtccctgagcaataatattgaccctcctggaatagattgccctgctgggaattgcagggaagagataaacttgcaagatgaagatctgggagcatctcagtcttacctttataaattccattccagccaccatactgggtgtttccaagttgattctctagggaaccgccgtgatccgacgtaaaataaatgagggtgctgttgctcaaaccctccacgtccaaagtgtcaaggatccgtcctgcaaagaacagatgtttttggggccgtcgaaatggaaaaatatcagaaatgcagctctgaagtgtatgctttagcattcgggggctagccacaagaatgaagccttagttttaacgcataatggaagtcagctgttggataattttgatatcctttgttggagattgatgtatgactttatatgcaccccatcctttggtcagaattttaggcaacgtacaaggacaaaatatcaaaaacttaaaagtgcagcatgcaggctgggcacagtggctcacacttgtaatcccagcactttaggaggccgaggcaggaggatcatttggggtcaggagttgtagaccagcctggccaacatgatgaaactacatctctactaaaaatacaaaaattagccgggcgtggtggcacatgcttgtagtaccagctacttgggaggctgaggcaggagaatagcttaaacccgggaagtggagattgctgtgagctgagatcacgccactgcgctccagcctgggtgacagagtgagactcggtctcaaaaaaaaaaaaaaaaaaaaaaaaaaaaaagtgaggcatgtgaatattcctgagaagaaagcatagactgaaaatgcagaccagtcctcaaaagtgaccctgagcttcttgcagccacacacaagggaactcatgtcattaatgtcactcacagttggccgggcacagtggctcatgcctgaaatctcagcaatttgagaggctgaggtgggaggctctttgagcctatgagtttgagaccagcctgaacaacacagcaagaacttgtctctacaaataataaaaaaattagccgggtgtggtagtgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttttgggaggcagggatgtgctgtgcccatatacaggtgctcacccagccctgactcactcaagcaatattccccttccatcctgttctaaacccaggaaatataatgagggaatgaggcaagacaatccggccccacaggagtttatattcccctgggggaaatggaaaatcaacctacctaacacatggtcacgaagagaagcaatggtgatgctgtgttaggaaaaaaagaagaaagaagacagaaagaagaaagaagaagaagaggaagaagtggaagaggaagaagaaggaggaggaggaggaggaatatgaagaagaagaataagaagaagaagaagaagaagagggggaggaggagaaaggaggaagaggaggaggaaaacaaaggcaaaacaaaaaaggaccacaggagaatgggggagaagatgattggggaggagctactttaggggtgcgtcagggcaggctctgaagaggagccagtgaagcctgaggaagcattccaggagggaacagcaggtgtggaagccctgacaggggacaaatgtgaaagatactgtgtggcgtccacgtggccagaatgcagcaggtggggaggacaagggggttgggtagaggtcagactaggatctgggcagcagcaggtcatggggcttttgtaggtgataggaggaaatttagtcctattttcagtgcagtggagccactagccactctacagcggagaggaattttatctgctctttcttttgtttgtctaccacatggcaataggacgtagacatctttggggccaaaattctgtatgccacttgggaattcagacgtggaaatctctgaggtcattattctctctaacacatggggattaagacgtggacatctttggagtcattattctgtctagcacatggggattaggatgtggacatctttggggccattattctgtctcccacatggggattagaaagtggctatctttggggccatttttatgtctaccacatcaagattaggacgtggatgtctctgcagccattattctgtctagggagtggacagctttctgccacatgggattaagatgtggacatctttggccgaatcgcattgcctcccgtgcatgtgttatggaattcaccctctgctaatgcagtgaagatctgtgctataatattttgcactcttaaaatccaatcgcactgcaatcgctattctgcatcttctgtctttaaccttctcattctttgtttcctttcctgcttctattgctggaagggaagcagcccattttccctggaagtgcacttacctaccatccagtccatctcctctacgttgtccccatacagcccgtggagactcttcccgaggaagttctccatagtgataagagggatgtgaacgtgtagaaaggaaacaaagaggaggaaaggcccatgcttattcctaaaaataaatacgaagcaattaaggtgacttttttggtaaaacagagattgaagtcctgtagatactaaatacggatctcacttgtcacatcattactcaaatgtcttctcaactctgctcaccaaaaagaaacactcaaaactcttcttcaacggaaaattaattcttatatttaacaatcttccttttttttttttttttttttttttggctattttaaagacagggccttgctctgttacccaggctggagtgcagtgacatgatctcagctcactgcagcctcaatctcccaggctcaagtgatcctcccacctcagcctcccaagtagctggggccacaggcatgtgctaacaggcccagctaatttttttttttttttttttttttttttgtagagacagggtctcactatgtttactaggctggtcttgaactcctcggctcaagtgacctgcccctgcccatctcggccttccaaagtgttgggattacaggcgtgagccaccatgcctttctggtctgttacctctctctgtttttcattttgagacggattgtggctctgtcgcccaggcgggggtgcagtggcacgatctcagctcactgcaacctctgcctcccaggttcaagcaattctcctgcctcagcctcccaagtagctgggatcacaggcatgcaccacaacacacgtcttgtttaagactctttaacatcatgacttttcccttcccttctgaaatctatttaaaaatccacactgggccaggcgtggtggctcacacctgcaatcccagcattttgggaggctgaggcaggagcattgcttcagcctaggagttcaagaccagcatgggaaacatagcaagaccccatctctactaaaaatacaaaaattagcgggatgtggtgacatgcacctgtactcccaactgctcaggagggtggggtgggaggattgcttgaccctgggaggaggaggttgcggtgagctgagattgcgccactgcacttcagcctggacaaccggattgaaatcctgtctcaaaataaataaataaataaataaaaacccacactgatctaatgcatcttttcccccccgaatattataatgttctaactctactgcttaatgcaaagttaaaagaactgtaggttactgacatgacttttattttgttcaattatttcaatatctatttttaacctcaagctttagcttatagaataagtggtgccacacattccattttctttataattgctatcacgtagtgaggattaggacataaaatagttataaaaaacacactttacaaatgaggcatattgggttattcatattatttccattgtcctccttgaaagcagtgttttagcttctccctcccttcacccggccttcatggtctaatctagatccttgaagcctaagagcaatggtgaaggtgttagccttaattagaacacgtcaggctgggcatggtgtctcatgcctgtaatctcagcactttgggaggctgaggcaggaggatcacttgagcccaggagttcgagaccagcctgggcaacatagccagatcctgtcacatttaaaatcaaaaagaacacaacagtcttaccctgctttaatttgcaagctaattgtcaatgtcctttc[133 bp omitted]caacatggcaaaacccatctctattaaaaatataaaagttatctgagcatggtggtgcatgcctgtaatcccagctacttgggaggctgaggtacaggaattgcttgaactcaggagcggaggtcgcagtgagccaagattgcaccactgcagtccggcctgggccatagctcgagactctgtctcaaaaaaaaaaagaaaaaaattatctaagaatgttgtaggagatgatgacaacctcattgtcaccaggtaaggtgacttttgatggtgttaccatctttactagaatgcccttggggagcatgaaaatagctgtgtagtactgagaactagtttcatcccatttctcctggtcccacacaggaattttccttgccataaaattgaccgcaggctgaattctgccaaaagacatctgacttctgaagatagacttttttttaagtttataattgattataaagcccttcaggtgatgcaggttacttaaatagtgtctgtggtgatccgaggatgctaatggaataagactgaccccagagtagtagcaaattccagctgacctgtaacaatttctttttgagacaaggccttgctctgtcgcccaggctcccttcatagcctcactacatagcctcaacctcctgggctcaagtgatcctcctgcctcagcctcccaagtagctgggcctacaagtccatgccaccacagccagctaatttttaaaatttttgtggaaatggggtcttgctgtgttgtccaggctggtctctaactcctggcctcaaattatcctcttgcctcagtctcccgagtagctgggataacaggtgtgtaccactatgcccagctcagctgtaacaatgttttaatggacacaaggcaagtcacagggctccactgaccctcatctatgccccattcttaccaaaaaattgtccttctaggtcatggctatcccattcttcaaacgtcaattaaagaaaacgactttttttttttgagacaggttctccctgtgtcacccaggctggagtgcagtgatgtgacctcacctccctgcaacctccacctcccaggttcaagggattctcccacctcagcctccc[134 bp omitted]cagcctccaaaagcactgggattacaggaatgagccaccatgcctgactgaagaagactatttaggatgcgttttcattccaaagctgagtgcttggaggaagctgacccttttctgctgaccttttgagaaaggacgcaacctcctgcagaataaggggtgtcgttctttggaagcacatgggctgctccgtgatggtgtggtttctcatcagaaagcaatcggcatggacaatcagagcacccacaaaataggagcttgcgaggaggaggacggccgaaagggctgaccagatgaccggcatccacgagacgggtatcaggtgtgtgagcttccctgctaccagtgtgagggcaaccaaggccaggacttggaagaggaagttgagtttttgttccaggttgacacgcttctctgagagttcccagcgggcgcaatcacccatcaaggagaaaggcattccgtagaaatggtcaaagccatgatggagagggtggtggcaatgatcactggctgactcacagttgagacccagatgccattttcctgagaggcaaaaaggatgttgatgtgacaagcatctgagcataactggacatgtcgatattgactgtttgtcacattcctgatactctgttagacactggggggccaggagattgcaaagaagtgtgggcagcattagctgttatttgcaccacaatctggcctcatcgtttcaggggaatgaggaccccatgtgtcagctttaaccaaaatattagttacccgtgacaggtggaacaaattactgtaaaactgttcacttaatacaacagaaatctatcctctcccagtcctagagaccaggagtctgagatcaaagtgtctccaggccacactcaaattggaggctctaggggaggatccttcctgcctctcccagctcctgagggctccaggcctccctgggcttgtggccgcatcactccagtctccatctccatgtttccatggcgttgtcctctgtgtgtgtctgcgacctaatctcttgtctcataaggacagcagtcatcgcagtagggcccactgtagagacctcatctttacttgattatatctgcaatgactctattgtgagctggatcctggcctgcctcaaattcatgagttgaagccctaacacccaggacctcagaatgtgactgtgtttggagacagggtgttcaaaggataattaatgtaaaatgaggtcattagtttgggcactgatatggtttggctgtgtcctcatgcaaatctcaccttgaattgtaataatccctatgtgtcaagagtggagccaggtggagataattgaatcatggaggtggtttcccctacactgttctcatggtagtgaatgagtctcacaagatctgatggttttataaatgggagttcccctgcacatgccctcttgcctgccgccatgaaagacatgcctttgcttctcctttgccttccaccatgattgtgaggcctccccagccatgtgaaactggaagtccattaaacctcttttctttataaattacccagtcttgggtatgtctttattagcagcgtgagaacagactaatacaggccttaatctgatagaacttgtgtcctataagaagaggatagtaggacacagacacacacatactctctccagaggctctaggggaggatccttcctgcctctcccagctcctggtggctccagctatcccttggcttgtggtcgcctcactttaatcacactgctttctcctctctgtggcccaatcttcctctacctccatgttaaacgaagccttgtccttgcacagtgggcccagctggataattcaggatcatcttctcacctcaagattgttcacttaatcacatttacaaagactctttttgcatataagctaatatttgctagattcagaggttagggcctgacatctctgggaccattatttagtctattgcaccttgttttgcagtgcaatgatgaaggccggaaagcaccatgtgatatcagcagcatgggcaaaagacttctggactttggaattgttctctctttgagaaaccactatcatagtggccatggttgaagtgggtggtgggttttgcaaggcacacctttcaaattcagtcaaaggaatatagtctttgcttccatgtagccactactatggtgttgacaaagagatgtcaaccaccccaatgctgtctgccatctggaaaacctcatgatttcccaatggatatcccttaaggatagactcttctgtcttagaaaaattatagttggccaggcatggtggttcacaactataatcccagcactttgggaggccgaggtgagaggattccttgtgcccaggattgctggagaccagcctgggtagcatgggaagaccccatctctacaaaaaaaaaaaaaaaaaaaaagaaaaaaaagaaaaaattaaccgggcatggtggtgcaagcctgtagtaccaactgcttgggagactaaggtgggaggatcacttgagtctgggaggtcgagactgcagtgagctgtgactgcaccattgccctctagcctgagtaacagagtgagtaccctgtttaaaaaaaaaaaaaaagtctattggaaaaaatacacctttgtttgacagcgatgactgaatctccccagaatttgttttttttttttttttggtaaaaaattaaacaaagaacattttataatttttaatttttagaaatatagtttattgaattttatactcattgtatccactagtcatgttgtttgttatcaataaatggaactgttgataacaatcattactataacacaataatgataatggcaacttggtctcctctcaaggaactgttgtcattaattttatttttcatccaatacatgacatgtttgttgacttgtagaaaaataaccatgttagttatggaagctgacagggaggtactaaatctagtaaagacattttcatacacaccaaggggaaaaataggtagcattacagaaatttttgatgcaagaatatattttttcttatttttttttatcatggcctacgagaacattgtttgagatgccaaatatttcattaagttgatgttccttttctttctttctttttctttttcgtagagacagggtttcgccatgctgcccaggctggtctcaaagtcctggcctcaagcgatccacccaccttggcctcccaaagtgctgggattacaggcatgagccaccgcgcctgaccagagtcacttttgtaagggcactaatcccacacatgaggctccaccttcacgacctcatcacttcccaaaggcttcacctcctgccaccatcacctggggggtaagggtttcaacataggaattttagggggacacaaacatttagatggcagcactaaactagccaagttgatccataaaccaaccagaaaagagctgaaggtgttcagtctaagacattcatgtctaagacaaaaagtccatgtgaagggtgggagaggatcccacagaacaaagaagcaattatgtgttgtgcaatggagcttggaacatatgccataggcatgagcacattttatttattttttaatttatttttatgtatttttttgtagacgtggggtcttgctatgttgcccaggcgggtttcaaacttctgggctcaagcaatccttccgcctcggcctctcaaagtactgggattataggcatgagccaccttgcctgagctggtatttcttgagtatctactttgcagaaaacaacctggaaaggaacatggttcctagatacatgcagctttctgtctagtgggaaatcccacagcacctcacccactttcctttccaaactctttagctgaatgtcccttccatataaaagtcatgtgcttaccacttttaaaaacgtacataccaatgagtccagtggcatagcctttctctttcagtatttttgcaaaagttgtctcatttgttggaagacctccagatgctccggtccactgaagaacacggtaaccaatgctggaaaccatccctttgagcaattattaagagaaagaattactgttccacattttttttcctgtttgttatttattatttattcaaaaatagaacacttggtaaaaatctctcttacttaaaattaaattgaaaatggacttcctatatgactttgcctagtggattgcatttttggcagcaaagtaaatgattaatttattgaaaaccttagcgagaagatggactttcctgttatgtgcaggttataagcaatataattcagtgaaaaaggactaaaaatttaaatggttttttgtttgttaattaatttatttaaagatggggtcttgttctgtcgtccaggctggaatgcagtggtgtaatcaatgtccactgcagtctcaaccacctgggctcaaacgatcctcccacctcagctacctgagtagctgggactacaggtgtgcaccaccacacctggctaatttttaaattttttgcagagacagggtctcactctgtcacccaggcttgagtgcagtggcatgactatagatcactgcagccttgaactcctgggctcaactgatcctcccacttcagtctctcaagtagctgggactataggggctcatcaccatgcctagctaatatttttaattttttggcagagacggggtctcactatgttgcccaggctggtcttgaactcctagactcaagtaaatcctcccacctcagcctcctaaagtgttgggattagaaacatgagccattgtgcctgaactaaaaatgattttataatttcatcaaactcttgatataatctaaaggttctcaaagttgtctgcccattggaatcgtgtggggagcttcaaaatattctgacgcctggttatcaccccaggggtgctaattttcattggtcttgggtggaacttgggctttgggatggtgggaatatcctctggatgattctaacgtactgacaaggttggtagccactgataaaattttattctgctctccagacattccaaatctctacccaagggtttttttgtttgtttgtttgttttgggacagagtcttgctctgtcacccaggctggagtgcagtggcgccatctcggctcactgcaatctccgcctcccgggttcaagcaattatactgcctcagccttccaagtagctgggattacaggcactcatcatcacgcccagctaatttttgtattttcagtagagacggagtttccccatgttggtcaggctggtcttgaactcctgacctcaggtgatctgcctgcctcagcctctcaaagtgctgggattataggcatgagccaccgtgcccagcctctacccaagtgctttaaaatgtaggtgttatgtattattattattaaggttttatcattcagctatggcaaggccaacagatcaggagatgactgtcattggagagatagtttattactcacagtttctgatagtttattactcacagttcaagaggacgcaggggtgagccatgctgtgtgactatatggggaagctccagggttggtcaggaggcagagggagtgaggggaaagcatggaaaaagcctttcttatttattgtttttcttttttggaaagtaatgggcaaggtagggtaagccggcttaagactggccaggttgtacaatttccgtgggctttcatctgcaggggctgtccctagaaagctggtacctgattctggggggattagggcaaggagagagtagccccatatatgaaaatctcataaaagtgatggttgggggtgtgggctctggactgtttggtttatgcatgaaaggtgcactcccaggtgacttgtttgctatctctaagaattggctagccctgggagggccagtcctgccaaggtcagcaaagccctaagatgtcaaagcatcagaatataaaagctgcctgggcacggtggctcatgcctgtaatcccagcactctgggaggtcaaggagcggggatcttttgagcccagcatttcaagaccagcatgggcaagatagagagaacaccccccagtctctatttaaataaaaaataaaaaaaccaaaatgtaagaactagaaactgtgacgaatacaccaggctgcaccctagtgcagttgtaaagagagactgacctgatcgcacagggtatctgcccgtgaggaaggcggctctgcttggggtgcacaaagatgcggcagagatgtgttgggtcagcttcacgccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatcgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagaccgacctcagagggaatgcagaactgagagcccagggcaccttctctggagctcacagtgttcatgggaaggtttgacttcatggacgccaacacactgtaagtactacatgagggtggaaggctggaattcggacaggaggacggactagctctagctcttgacagatggacacgccatattttggcattaggagggtgtggacttgtctgtctgaagcagagcttttcagcaggggaggattgaaatcccgcataagtgctgggcttggctagatggatagggttgggagtgagacagagatcaatattggtcttctgcttacaggcaacgacactgatttctcctgtatgtttgtttatttgtttgtattttgagactgagtctcactctgtcacccaggctggagtgcagtggcactatttgagtctcactacaacctccccctcccgggttcaagtgattctcctgcctcagcctcccaagtagctgggattacaggtgcccgccaccatgcccagctaatttttgtatttttagtagagacgggggtttcaccatg[138 bp omitted]gtctgatcacagctcactgcaaccttaaactcctgggctcaagtgatcctcccacacctcaccctcttgaataactaggattacaggtgcatgccatcatgcctggctaattttttttttaatttaaaaattaatgtgccaggcgtggtggctcacgcctgtaatctcagcactttgggaggctgaggcaggcagatcacgaggtcaggagattgagaccatcctggctaacatgatgaaaccccgtctctattaaaaatacaaaaaattagcggggtgtggtggtgggcgcctgtagtccaagctacttgggaggctgaggcaggagaatggcgtggacccgggagacggagctggcagtgagccaagatcatgccactgcactccagcctgggtgacagagcgagactccgtctcaaaaaaaaaaaattaatgtttatattttctagagacaggatttcactatgtttcccaggctggtcttgaactcctggccttaagtgatcctcctgcctcagcctcccaaagggctggtattacagtcatgcccggctgatagcatttctaaagcattgtccattatgtactgggtggataaaaatcatatttaaaaaatgaaatgaggccaggcacagtggctcacacctgtagtcccagcactttgggaggctgaagcgggtgaatcacttgaggccaggagttcgagaccagcctggccaatatggcaaaaccctgtctctactaaaaatagaaaaattatccaggcatggtggcgggcgcctgtaatcccagctactctggagagtaaggcaggagaatcactggaatcgcagaggcggaggttgcagtgagccgagatcgcaccactgcactccagcctgggcaacacagtgagattctgtctcaaaaaaaaaaaaaaaaagaaaagaaatgaggccaggtatggtggtttacatctgcaataccagcactttgggaggctgaggtgtgtggatcacttgagcccagaagttcgagacgaggctgggcaacacggcaaaaccccacctctacaagaaacttacaaattacccaagcatgatggtgggcacctgcagtcccagaattactcgggaggctgaggcaggaggatcacttgaacctgggaggtcaaggctgcagtgagctgtgattgtaccagtgcagtccagcctggaccacagagcaagactttgtctcagagaaaaataaaaaataaaaataaataaataaaaataaaaatgaaatgagcagtcatatgtaggatggattgaggtgaggttagtgctggcatgggaagaaagtaacattagggagagttagaaaacgcagaagtgcagaactcttgaagtgtgaactgccaagatcaagggttatatgcattttcagtggcttctctttcttctggtgtctgcattgggggcaccaggtgagtaattctctgtcccttgcctcatggtgttgttgccatagcagccaatgtccccaatgccaaggtcgtccgccatcagaagaaggatgttcggtcgggaggcggaaatgtcgctggaagctgatggtgccaaacttagcagtacagcgagcatcgctggcagccagctcctgaaacacaaactgtcagagactgcgtcatgctcctgtccatctcatttgcagaacttgtgtatgggggaagttggcatcactattttaagaggtattgatattatcatcacatttcagaatagctttgaggacatctcttaggcatttgattgtttttctctggttacaattaactgataccgttgatggctttatttggccttgaagttttttgggttttttttgatgctgtaaagtctgttgttaagtgattaaactcatgattaacagaaagccttggtggggtgcagtggctctctcctgtaatctcagtattttgtgaggctgcagcgggtggattgctttaccacaggagttcaagaccagcctgcgcaacatggtgaaaactcatctctacaagaaatacacagcttagctgggcgtggtggcacgtgcctgtagtcccaactcctgggaaggctgaggtgggaggatcgcttgagcctgggaggttgaggctgcagcgagctgagatcgcaccactgcagggcaacagagcaaggctgtctcaaaactacaacagcaacaagaaaaagcaaaaacagccagaaagcctgccttagtcatggtttcttggatggatcgggtccccagaacagctattgccccttctccattccctcttcttcattgttcttccttaagcaaactgtgttgaacatagggaatggaggctggggttagggtttggaccacccagcagagcaaggaagagacacaagcttggggcaaggtgagaacacagtgagctgctacttctgagtctatgaaaaccctctgttcattgtagcacacagatgaaaatacccaggactgacttctttagcccactggtatctgatgagaagtgggtttggaggtgaaggaggttccagcctggaggagaaagccctggtagttgcgtaccatgagggaacatttccgcaggggttggtgacatacagcctgccactatcattgctgcctctttcatcgatgccaccctgggaatgcacatggacagcagggccatagtgtcccaatccccagtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatgcccattatctgagcacgttgggaggccaaggtgggagcattgcctgagcccaggtgtttaagaccagcttgagcaacatggtgagaccctgtctctatataagaaaggaaaaaaaataaagaagggaaggaaggaagaaagagagagagaa[359 bp omitted]aagggaaggaaggaagagaaagaaagaaagaaagaaaggagactactaatgagtgcatataattgtatcttaccaagaatggtgcagatgtaacatgttgtctctctctctacttcctgtaagacataaagatgtccacaatcacattgacagcagaaattgacctgattataaataaaacagtaagtaagtaattaggggaactttgattcccgttcatgatatcaatagcaaaaatatcttaaaacaatgatcaaaatctataaaggaatgctcttcccgagtgaaaaggcttcaaaaatgtttaatactatgttaagaatgtaaaacgtgtttcaatacacagccagatggtcttcagagaaagaggaagaaagtggtcatagggtctccatcccctttatcagctttcatagcccatgagtgatcacaaagtgatgagagaatcccagtgtccggaagcagattattttgtcttctgcttcccgagcccagggcaggggtgattcctaatgtccagaaatgcagagagagagtcctgatttggaagggggaagcggggaaagatcaaagcttggatgatacacaaaagaatctgagtagagggtatgaagatcagaaatacaatgagaggctgcgcgtggtggctcatgcctggaatcccagcactttgggaggcggaagtgggaggatttgcttgagcccaggaggtccagacttgaaaacagaactgggagtgtcagtgtgaaggaaaaaggcctagaggactctgcaggcactgagtgctgcatgaaggagagacgcattcgccttcattgctaggggtaggtgctgccgggagagggggcgaccattgcccacacttggaaatgttctgtccacagagggaaacgggcgacccccaaagcacagaggggcggcccctcagtctcgccgagaagtgagggagagcccagggtgtagagcaggaaaggaatgagatggaagataacaattagagttgcaggcagcaagaggtcaccttcagggtactgcagtggtctgaccccatgtggcttgtgcatgggactgaggacgaagctctgatttttctttttatcttgcccaaattcctatctaaggggtctggagagtcatgccctacaaaccaaaaattctcatcagaagggtttcatttaactatatattgtgacttactttccaatctgactctggcataacatgagaccaataagaaaatcaaaatattttacccaaaaacatgtttctttgccatatcttgaaatggccctgcaaagctgtcctttgtggggaaaaatttgcatctgtaaagatgtaaagaatctctattcacatagatattcacatctttttctaccggacccttccaatcctgaaaagattgactaagactctagcaccttttaaaagtctgaataggaaacaattgtcatctattgtctctaagggcagccgctacaagacttcaaaataaccttggtctccacaatcttttctcttaacctgaagatttcttttctagggatcccagggttttttttttttttttttaatctttcttttttatttttttgagacggagtcttgctctgttgcccaggctggagtgcaatggcgcgatcttggctcactgcaagctccgcctcccgggttcaagtgattctcctgcctcagcctcctaggatcccaggtctttagatgaactcaaccaattgtcaaccaggaaatgtttaaatctatgtataagctggaagccccctgactttgagttgttccacctttctggaccaaaccaatgtgtatcttaaatgtatttgattgacacctcatgcctccctaaaatgtataaaacaagctgcaccctgaccaccttgggcacacgttcttgggtcctcctgagggctgtgtcatgggccatggtcactcttatttggctcagaataaatctcttcaaatattctacagagttcgcttcttttcgttgacaggacatgggcatgcatagaagataaagagacaggagcatgcagatgtgttgggtttctgcctctgagtaaccaggggagtgacctggccacttttagaagggccgagcggccagtgagtgaggacacactggagccagcaggcactgagagcctagaagtggccgtggtgtctgtccaggtgaaacctgaccaaggatagacacagctggtgtgggagcggggagggcagagaggaggggtgggcaaggtccgcagggctgcgaaaccccagggtgtgagtgggagagaagcgattggttgagggatttcccctcaacgccttttcggggatgctgggaggggtgtttgctcctagcaggattcaggcacaaaaccagtcttctgagaaagacaatgagctttgtgaaaggaaaataaatctcaaggcccgcaagtcaataagctaaagggaaaagtcaagcggggaactgcttagggcctctgcctcccattctagtcaaagtcccccctttgctcactgagatagatgcgtatctgattgcctcctttggaaaggctcatcagaaactcaaaagaaggcaactgttcctctctcacctatctgtgacctggaagccccctccctgcttacagtcttcctgcctttgcttcaagttttccggcctttccagaccgaatcaatgcacttcttacattattgatggatgtctaacactgaattgctacatctccaataattttctgtctgtcgaagagaaaaagaccttagatatcatttgtgctttgtttagaacacagaaggaagggataaggtgtacgccgtgctcgtgaggtttttttgtttatttgttcgtttgttttaccctagagagcacacacaattctcatattctaaaagtaatagcaaaagacgcaattacgtttcaccaacctaatagcatcttcaccgggaaagagattgatttaaaattgtacatggagagaaaaccaaaatgagcattttaataccctcagcattgctttctgacctacaatgacatgctgccaatggtcagaaaacggaataaaagcaaaatactgtacaaatgtaatgagaaaaccccaaaccaccacaaactaggggaagatggtttttgcagcaatcctgcccagcagtggtttatctctgggtgtggagatttaggaaaagtgctctttttctaatttttcttttcttttcctttttttttttttttttttttttttgagatagggtctggctgtttcacccaggctggagagcaatggtgcgaccatagttcactgcagcctcaaattcttgggctcaagcgatcctcctacctcagcctcccaagtagctgaaactacaggcacatgccactatgcctggctattgatttttttttttttaagtagaggtggggtttcctcttttgctcaggctggtctcaaactcctgggctcaagcaatccacccgcctcgacctcccaaagtgctgggattacagacgtgagccaccgtgcccgacctaatttttctttctcccgcaatgttatgtatttataagtaaaaatatgaatattttttcttggagaaaaacgttaaataaataaagagatggtgataacagccttgaatgagtttaattttggaaactgtgacattgaggtgacccagagcatggggcctgcccaaggcctctcctgcagattagaaaacagatcccccttctccaggaaagagctgcattcctaggcctgtaagtcacgggtacgtttctgctttatcaaaacaaactgggcaattattcagagacagaaaagggaacggggagctctttgttcaccacgctattcatgcctggtcacggagcccaaatccagcacaaatgaacattcacaggactcacctctgctcctgggctccttcctgaatccccgatcaagaagaggaaggttctctcccaaaggaagcaagcgtgaaggcagagagcacttgcacaaggctttgagctgggaatgattaacttcgagtttgtttttcccaagtcagaagatcagagagagttaggacagacagagcagactccccccacatcgcagcatgggggaatctcaaagccacgcccacgtctaccaaaccagtggtcagtttccttaggtttttattttgttttattttttgtagagacggggttttgccatgtggcctaggctggtctcaaagtcctgagctccagtgatctgccctccttggcctcccgaagtgctgggattacagatgtgagtcaccgtattctgccagtgtccttaggtttttaagtgattgcctgtgctgttacacagggtgctggctataatatgatcatatccaacctggcatggtggctcatgcctgtaatcccagcgctttgggaggacgaggcaggaagattgcttgaggccaggagtttcagagcagcctgggcagcaaagtgagatgctgtctcttcaaaaataaaaaatattaggctgggcagtgtggcttatgcccataatcctagcacttggggaggttgaggcaggaagatcgcttgagcccaggacttcgagaccagcccgggcatcatagcaagaccctgtctctataaataataaaacaattagccaggcatggtggcatgtgtctctactgccagctactcaggaggctgaggtggaaagattgtttgagcctgggaggttgaagctgcagtttcactccagcctgagtgacagagcaagaccctgcctcaaaaaaaaatgttttaaagaagttatttgttgagtggtaaatgaagtaaataagaaataataaagataagataaaaataaaaaagaaaacatttcttaaagtaaataaacaaacaaacaaaagaagtaaaaaggccaggcgcagtggctcatgcctgtaattccagcactttgggaggacgaggtgggccgatcacttgaacccaagagctcgagactagcctggccaacatggtgaaaccctgtctctgctaaaaatagaaaaattagccaggcatggtgtcacatgcctgtaatcccagctactcgggaggctgaggcaagaaaattgcttgaaccccggagtcggaggttacagtgaggcaagatcgcagcattgtactccagcctcagcaacggagagagactctgtctcaaaaattatagtaataataataataaacataagataaaaagaaaaaaaataagcaaaaaaaaaagtaaaaaaaggattattttcaagcaatgcttggtttaaaaacatagaaaagacgggctgggcacggtggctcacgcctgtaatcccagcgctttgggaggctgaggtgggctgatcacctgaggtcaggtgtttgagactagcctggccaacatggcaaaaccccgtctgtactaaaaatacaaaaattagctggatgtggtggcgtgcacctgtaatcccagctacttgggaggctgagataggagaatcgcttgaacccgggagacggagcttgcagtgagccgagactgtgccgctgcactccagcctgggcggcagagtgagactccgtctcaaaaaagaaaagacaagacaagaccaagagggcaggaagcagtttctgaggcactgcatgatcattgctgggaagttactctgtagaatggaaccctacgcaatggtccctattattcaaccatccttgacctacaaggacggggtttcatagagttccacctgctgtctcttcgcaacttcatatgcagccacatgctgggtctgtgagaagtcacatagcctacctgatctcacttcctccttatgtgggggtggaaaccaccctacttctgggatgaggagctgacacgctggcacactccagcctgactcatttttacaagtggacggttttggtggcatgtctcaaaacgagtattaggaggggtgtcagaaatgttttcttttcctgccacaggtgtgtgccctaatggtaattgctttcactttgtgatttttggcaacaaatcttaagtcatttcctcgtagggggcctaaaggaatattttcacctatattttaatttatatattcataattattatatataatatagtataacttttgtacatcatacatagtataaatgtatcacataaaatatgtaaataaggctgggtgtggtggctcacgcctataatcccagcacttagggaggccgaggtgggaggattgcttgagcccaggagttcaagttaagtctgagcaacaaagtgagagcctatctctagaaaaaaaaaacaaaacaataaaatatataaatataatatataaatatataataaagcataatttttctttattaaaatatgcatgcttttctttacaaaaataatatatactttaaaatatatatgtacatatatgtatagatacataaaacatgtacatatacgtacacatctacatataaatacatgttataatatgcacgtataaatataaacatataacatataaacatgtacctatagacatctacatacatgtttatgtgttcatatatgtatgcttatatgtatataatgtatacatgtacatgcatgtatatatacatacatatatgtatacataacatatatacctataaaacatgtacgtatatacatgtaacgttaatatatgtactttttaaagtaaaaatgtttatgtgtgtatgtatagtacatatatacatataaaacaagtacatatatgcatataacatatatatgtacatgatttttcaaggaaaaagcatattatgggctgcttctgacttgcctggggaacatgactggttgtgtttgttttatcgggctggttatattggtgtctaaatataggaccctcaaacatgtttgaacagtcatatgacgtacggttagatatcaagtctgtggcctacctctgaactgatgtatttatgtatttagtgacacaataaaagcagatttttcttttccaaagaactctgcactttaacccttggaatgttaaacattttggtccagatttaatttttactactgaataaaactttctacttttttattctaaagacacaaggtatctttagaaagagacaagaggctgggcgcggtggctcacacttgtaatcccagctggcacactctggcctttgggaggccgagatgggaagatcacttgaggccaggagtttgagaccagcctggacaacacggcaagatcctgtctgaatttaaaataaaacaaaataataaaatatagaatacagtaaaatataatacaatgcaatagaaataaagataaaagaagcagacgaggaaacacccatgcaagactgacaatatagcctttgattctcttccggggagaaggaatcccagccctcctttcccgccctgagcttcagccccgggctgcgagcctgtgttcaacgcttcgcctgggccctgttcccaaacccagtttcgcttttcacctccggtgtctcttcgatgttcagtgcacgtgccttcagcatctctaagataagaatctagtgtggatgcaatgtctcccatttggtgcatcttccctcgttgctttttttttacgcattacgtttggaaatctcccatgtaaaatctgtacttgagattttcactgatgattattattattttttgaaagcaaattacttttaaaacattgacagggacttgtttgaaaagacgcagtttagcataaaagaatatcccctggagcgtctctgcacgtgcaaaagccggcctgtaagaagaagccccaggaaggccagttacctgacatgcagctgtgtaagggcgacactggctggatgtagcggggaggctgctccttggaagaaacgtcttcttcctgccaaaacagacacgcactggctgtctcggcggcactgaacggctggctcacgcatgtgcgtagctgattcactctgaaaagcaaaaacaggaattccgcagaaaccaagttaggttgtcccagaaacagatcaggcaagtccccaaggaatgtactgctgggtctttcaggcgtccacaaaagaccttctgttctatttgcagaacctcactctcgcggaaggagcccagacatctggtgctgaacgcggggtttttcaatggcaggaaggtggaatcccttcgggcttttgatgtaggcagagtgcatttcccaaagtggaaaagtggttttcttaaaactcatcttgaatcatcactccgtagcccttcaatttcacgcctttttctttccttttgctatttgcctcaaacataaaaagaagacaggaaacaattcaggttacagttgcaactatgactgtgtgtacacagccgcaactattaccatatgtatatagctgctcacctatgtgactctgtcactatcacttccgtttagctctgtgcaccaatgtgttttctcatctatttgccagggagcgcatttcttttttcatattgaagcagagcatacattgcaggcaacgttaggtgtaaaacgaatcacttcaaggactttttttttttttcaaataagagctgtctgcacacttctacgtgttgaatcacaaaaatattcatcctaatgcatttatagtctctatagcctgaacattgcagagttttgatttgagactcccgcttgccaaataagccctcttataaatctgcagctgcctacattcttcatgagtttaacacatcagaaagaacaaagcataggctcgacgggctgaggaacacctaccgctctaggccaagtctactaggttatgttgctcttgagggaaggctgtcaacactcatgcagttattttttgcacaagttgaacatcaaggagataaaaccgggatccaaattggaactcccaggttggctgaacttcagcctgactttctatgttctgggatgaggcatggttacgccactaccctactattgacctctgaggaggatgattctttattgtaggggccgtcctgtacattgtacaatgttgaaaagaatccctgggctccactccctagaagcaggtagtgatcaccacctcctccccagttgtgacaaccggaaatatctccagccgtggcacaatgtctcccgggggggcagaatcactccggttgaaaacactggtgttaaggacgtactttgcaggtgactggagaacacttaattacgatcatgctgggtgagccatttcaatttgtttctcatactcccacgtccttcagagctggtagcagaatcaagctccacacctgaaactcttagcacgaacgttatacaacagtacttgtcagctgcatttccaatactagcatcccaaaagagatactctcttagcatcaagtaaagtcatttactctttttttgttttttgttttttttttgagacaggggttcgctctgttacccagactgcagtgcagtggcacaatcactgtcactgcagcctcgacctcctgactcaaatgatcctcccacctcagccccctgaatagctgggaccacaagcacacgccaccacaggtggatcgctttttttttttttgtaaaaatggggtcttgctatgttgccccctctaatcgctaactcctggcctcaagcaatcctcctgcttcagcctcccagaatgctgggattacaggtatgagccactgtgcccatcctaacaatacatattctttagcaaagttcagatccccaccgtcatcctaaccttgtcttctgcacggagctttcgtctctgaacaaggcggacgttcgctttcccttgactccaagttgaactacgaactaaagtggtctcattgtcatcttgggcaccatatgctagaagaagcaagacaaatacaagacaacaacaacaacaagaacaacaacaatgtagcctgtgaggttagaagcaacatggaatcagtcatgttcgatttctctcattatttataattctgtaaaggtggtttcatccatctttcccaaacaaccacttcatattccactctagctggaatttatttatcctgggctatggtttaaagtgtcactgtaaagggtgacataaggagccactccttttgggcagaattccttctctacctcaaattccttctctacctggccaccattttccatattccttgcacaggtaatacttgaaaatattcagacataacttaacattttcatatgggttgcatacaagaagacaatctggaaatccatgtttctaaactagttgcttcagctttgacattatgaagaaaaagaaacgcccatgggggtaaaatggatggtttgtccacatgagaaaatgtcttatatacggtgatgtatttttaagaaaatctatgaaaagctatttttatctcaactatcatcatctactttgaacagaacctgacttaacaaaaagttaggtgggtgcagtggctcgtgcctgtaatcccagaactttgggaggctgatgtgagaagattgcttgagcctaggagttcgaaaccagccttggaacatagtgagacctggtctctaataatttttttttttaataaaaatgttgctgttactattgtgtctcataagtatcaaatcttttctaatctctttggactcctaatccctcacccattctgaagatgtgcatgtcagcatgcatctaattttaaatagcaaaacatttcttatgttgcacttatattgcatgtcataaatcaagagaagtcggtgaagagctacaaaaataccattggatagaagggataagttctagtatttgatagtacagtagggaaattatagtgaacaatgatttgtccagcctatgaccctgtctcaaaagttaaaatgaaaacaaaacaaaataatgatttgttttatgtttcaaaacagctagaaaagaattgtaatgctccaaacaccaagaaagtatgaatgtttgatgtgatggataccccaaattccctgattggatcatgacacattgtttgaatgtttcaaaagattacctataccccccaaatatgtacacagccaggcatggtggtgcacacctgtagtcccagctacccatgaggccgaggcaggaggatcgcttaagactaaaaggtcgaggccacagtgagctgtgattgtgccactgcactttagcctggacaaaagagtgaggccctttctcatgaaaaaaatgtacaatgatgatatattaattttaaaaaatgagatgagatttttcccttgacccccttcatgggccggaactggagtggctcatttcactcagcctgcagtccatggatgactaagtgttaacagcccagcaaagggtcagagtgacagccttctgcacctgccctttttgacacccgagttcttgtttggcatccaggtggtcacagaaatggattgaagggtagtgtatgcggaggattttactgggcgatggatgtggctctcagatggatgtgctctcagcagaatggggagttggaaaggggacggcgtgggaagaaggtgatctttccctgaagcccagccatctctgactgggctcccatctgaagctgcaccatctgaagttagcttctatttgtagtctcccttgctcagccacttgtatacccgacgctcagcagcttgcatccctgactgcttgcatcagctgcttgtgttgctctgccagcagaagtctggtttttatgggcacaggacagggggcagggcaggccaaaagggcaatcatttgggttgaaatatgggttcagctgttttcacttaggactaaggttccaggcttgggggtgaagtttagccaggagcccagttgttctgtaccattttccccctctggagaggcacatctaactgcccttagaaaatggatgacgaccagtctgagctacttcctgctgaaagagggcgttgtttggggaaaatggcagttagattcctcccagaggtctcccaagagtccccggcaaaggcgagccatcatccgaggctccggctgcctgcccatttggagccttgatggcctctaggtgaaagaataaacaagctttacaaggttaagtaggcatggatcaaacatgtgtattatacaaagaaagaatgtagtgcaaaacatctcagaaacaagaaataaaacaacactgtaccccaagctgcctcaccctggtgaaagaaattaaacctcgtatgggagcagttaaactttatgagccagagaagtgctctcgccacatctgtcggagttaacaggtgaatcttaggaattctgaggcttatgggcttgccggcgggcagtaaagtttctgcctctttcttgtgtctaaaagaccaaggtggtcgttttcaggatgtcctctaaagtactatctggtcccagggtctgtttctgagtataaactggaggtggaaaattgtgttggttgcccattctgaagacagggaattaggcttccctcaattctctttctcctttcagtgataacctggggtatgagggagagaggaagtgggcatcctcctttcctcttctatcttttcatccccaagtcccagcaaccttgacaggtgccacccatgggtgccaatgtggcttgcacccatgaagccgggggagcctagagaataggaatgattcacactcacctatgcctctacctcccctgctgttgacaacctttgagttccttggcaggtgccacccatggctatcaatgcagcttccacctgtgaagcagggaagacccagagaatgggaattatctgcactcacctatgcctctacctcccctaccatcaacaacctttgagtttcctgggcctcatttatgccatggagtatggcctccttccgtaaagcaggggtttaatggacaggaatttgtcctgcctatttacactgtgcctgttgcctggctcagatctggttttcctttctagtgcctcgacctgcagcttggaatcgagtttgagaccaaaaaaaaaaaaaaaaaaaaagtatttcaggggctgcatagatttatttagattaagtcccaaacaggccttgccaaatttacagctaacagcctgcagacaatgcccctctgtcgtttccccatcataagcagagtgctgacgtagacagagaactctcttacttggaaaagaagaaaaacaacttaaagtgcatggtggcgggggaagctggggaaagagcctcttgctctgtggaaatgggttcctttaaccactgcatccctcccccggttcagaccagctagactttcatgaagggaaacagagccaacattcctttttcctgaagaaaagagagaggaagcagggtctcagaaaagagacagatccaacaattccgcattttaacccaccctttgttgtatcccagacgagcctccagatgagataggattgttcccttgaccccctttgtgggcaggaactggagtggcttgtttcactcagcctgccattcctggacagctaagtgttaatagcccagtgaagggtcagggtgacagcctcctgcacctgcccttcttgacacctgcattctttttcagcatccaggaaaaatctggtcacacgagcagattgaaaggtagtgtatgtggaagattttattggcaatggatgtggctgccagcggaatagggggttggaaaggggatggtgtgggaagatggttagctttccctgaagtccagctgtctctggccgggctgttctcagaagctgcactgtctgaagttagccatgtctatctgtagtctccaatgctcagccacttgtatcccagccttcagcagcttgtatccccaaccacttgtgttgctctgccagctgaagtctggtttttatggacacaggatagcaggtggggcaggccaaaatggcaactatttgggtggaaaaacgagatcagctgttttcacttaggtccgaggttccaggcttgagggtggagtttagccaggggcccagccattctgtaccaaatagacatgaaatgaagtagaaaaaggttaaacaaactgagagagagagaaaagtgcccaaactctatgagtggcaacttcaagaaatcaagtaaagggtcccattaggacaataaggaaggaacctacaaatcagcatgactaaatgctgcttctaaggtccaacactgaatttatacccgctcgggtccacaaagaatagaagaggagacataaatggtaagataaaaggtgaaatcttcttccttggtctgtgctttttatctcatctctagcctatcccgtctttattttatctttatcaaagtggggcatctcctaaggcatgtttgtgagaaacaagaaagaaaaaactctcgtggagagagttagtataatcccagcactttgggaggctgaggtgggagggttgcttaagtccaggagttggagaccagcctggacaacatggcaaaacctggtctctactaaaaatacaaaaattagccaggtgtggtggctcacacctgtaatcccagctatgcaggaggctgagacaggagaatctcagagcctgggagtctgatgctgcagtgagacaagattgtgccactgcactccagcctgggtgagagaatgagatactgtcaaaaaaaaaaaaaaaaaaaaaagaaagaaagaaagaaaaaaagaaaaacatccaaaaaacctgtgagtcagaatttctacaggttggctctgtaccagaattgcctcagacagtttttcacattgtgggtttcaatcctcctttccagcttgtctgaaccatggcatttaggtttggactccatgcagtattgtttttttaaaaatctgtctagttgaatgtgcccaaccacaactgtgaatgcgtcacagcattcagctctaatttagctttttcttgctaaatatgtataaatatatgtataattctgcaaaagagcacttttctcagaattatacacatatttatacatatgcaaatgcacacacatatacatatacaaacatatatacatatactatacacacatgcataaatatatacacatttgcacacaaacatttataaagatacacttatatataccatacacacatatacacatacatatatacacatgcacacacacatacgtatgcatccacacatatacacatgtatacatacacacgctgtacacttatacatatgtatagacatgcacccacatacacatatatgcatgcatataccatacacatatgcataaatatttacacattcatacacacatagatatacacatatttatatgtgatacacacatgtatacacatagatatacatatacatataaacaccatatgtatacatacacacatccacatactatgcacatatacacatatacacatcatatatgtacatttacacatttacataccagacatatacacatatatgcatatatacacacataatgcacatatatgcatatacatatatgtacacatatatacctgtatacatacaccatacatatacccatactaatttatatgtatattttaaaatttttttgtagaaatggggtcttgatatggtgccaaggctgttcttgaactcctgtccttaaatgatcctcttgcctaggccttccaaagtgctgggattacaggtgtcagccactgcactcagtccccttactcatatataatgcacatgctatacacatacgcaaaaacatacacattcacacaagcacatagatatacacatatctgtcatacacatatatacacacatatctgccatacgcatatatacacacatatatgccatacacatatatacacacatatatgccatacacatatatacacacctatgcatataaatatacatacacacatatacatacatcatgcatacacacatatacatatataaaaacctataccatacacatatatctaaacatgtacctattaagaggcacacacatacatatatgcacatacaagtaccatatacatacatataaacatatatatactatacacacatagacacatgcatatatatgcgtatatatacaagtaacacacatgtacatatgtacacacaccatacacatatacatatacacatgcactcacatatatgtatgtgcatgcatatacatatacacataatgaatgtatatgcacatatcacacacatatacctatacatacatgcacgtatacatatacatgcatgtatatataccatatacataaatatacacacatgcatattgacatacacatagacatgtacatatacacatatgcatatatatacacatataaacacatattcttcagtaggcttgagaaatgcagttagagagacttaatttagctagcagcactggacggcctccaaaaaatatttagagttgcctggagtcttatttttaatttagtttttgtttaaaagcaatcaactttattgatcaatacttcacatacaataaaagtatcagttttaagcacacagttcaataagtttcaactaatgtatacacccaagtcactaccgccacaaatgaggtgtagaacatttttgtcaccccaaaatgttccttcatgctccttggcagttaaaactctttcaccccatctcccaatccctcactttctggcagctgctgatcattttttcatcattacagattacagttgacccttgaacaacaggtctgaactgcatgtgcccacttatacaagaattttcttccactctgccatccctgagacagcaagaccaagccctccttttcctcctcctcagcctcctcaacttgaagacaaggatgaaaacctttatgatgatctacttccacttagtgaacagtaaatatattttctcttccttatgatttccttccttcttccttcctctttcttttctttcgttctttctttctttcttttctccttctttcttttctttcttttttttttttgaaggtcttgctctgtcatccaggctggagtgcagtggtgcaatcatggctcactgcatcctcaacctcctggactcaagcaatcctctcacctcaacctccagagtaggtgggactacaggcacatgccactatgcctggctaatttttctattttttgtagagacagggtctcactgtgttgcccaggctggtctcaacttcctggcctcaaacaatcctcccaccctggcctcccaaagtgttgggatgacaggcgcgagccactgaccccggccatgattttcttcatagcattttttccctctagctactctactgtaagaatacagtatataatacacagagcatacaaaatatgcggtatattggctgtttatgctgttagtgaggcttctggtcaactgcaggctattagacgttaagttatgggggagtcaaaagctatgtgctgactacacccctaacccctgagtttttaagggtcaactgtaggtatacctgtcctagaagttcacatacatggagtcacattaagtatataaaatatttattttacgtctggcttctttcggtcaccaaactatttttaggattcattcatcctgttgcatgccttatcagtgtgttcctttttatagctaagtactagcagattctatagatatcaatccatccgttcttccccaactgatagaaacttgtattgtttccagtttgggggcaattataaataacactgctataaacattttttgtgtgtatggacacattttccaattctcttggataagtacctaagagtgaagtttttgagtcacatggagagttgtatgtttaacttttttgtttttgttttttggagacaggtcgtctcactctgtcacccaggctaaagtgcagtggtgtgatctcggctcactgcaacttccgcctcttgggtgcaagtgattctcatgactcagcctcccgagtagctgagattacaggcgtgcaccaccacacccggctaattttttgtgtttttagtagagatagggtttcaccatgttggccaggctggtctcaaactcctggcttcaagtgatccttctgcctcagcctcccaaagtgctgagaccacaggtgtgatccaccacgtctggcctattcaacagctgggcatggtggctcatgcctgtaatcccaggaatttgggaggctgaggcaggcagatcacttgaggtcaggagttcaagagcagcctgggcaacgtagtgagaccacgtctctactaaaagtacaaaaattagctgggcatggtggtgcacgcctgtaattccagctacttgggaggctgaggcatgagaaacactggaacccaggaggtggaggctgcagttgagctgagatcatgccactgaactccagcctgggcaacagaggaagactctgtttcaaaataaataaataaataaataaataaataaataaataaataactgagctgttcattttcttattattgaattgtaagaattctttatatagtccagaaatcagatgtatgtttggcacaaatatgaacggataatatattgtaacaatttgttgctttccttttcatttccttaacactattgttcaacgagcaggagtttttaatttcaatgaagttcaatataccatttaaaaaaaatagtgtgtgcttttgatgtccttttaggtaatctttgcctgcccctaaggctgaaactcctaagttttcttctaaaaattgtaaagatttacgtttacagttaggtctgtaatacattttgagtgttttgtttttttttttaatagcatgagagaaaggtcaaatttcacatcagttgttctggcactttatttgtttggaaaaccattttctgcctttttgcttaccttggcgacaatgtggaaaaattcataaatgagcgtgtcattcttgaattctcctttctgctccattgacccgtaactatgctaatccgagaccatacttgtttggaatcttttccccccttcttttcacatgtgtttatggaatcttacattttctttcttatatttttctttcttcttttgagacagagttttgctctgtcacccaggctggagtgcagtgccacaatcttggctcactgcaacctccacctcccaggttcaagcaattctcctgcctcaacctcccgagtagctgggactacaggtgcacaccaccacgtccagctttgagtacagaaagtggtggtggctacataaccctgtgaatgtgtttaatgccactgatttgtaaacctcagtgttccttcagaataaattgatcatgaatttattccttcagaataaattgatcatgaatttattccttcagaataaattgacattgatcatggtcaacatgataaatattaagctatgtatattttaccacaataaagaaaatccaaccaaaacaaaaaacggtccagaaaagactgaaggatgctaaagagacataactaaatgtaacataggatctttgattagattctggacctttcaaggacatttttgaggacatcaatgaaacttgaatgaagtctgtggattagacagtaattttgggtgatcatttttttgttttctttttagtttttgtagagatggtgtctcactctgttacccaggctggtctcaaactcctgggcttaagtgatctacttgcctcagcctcccaaagtgctgggattacagatgtcagccactgtgcctggcctgggagactgttaatttgttggttttggtgagtgttctgtgtttatgtacattgaatatcctaatctgtagtttatagggtttggctgtgtccccacccaaatctcaccttgaattgtaataatccccacatgtgaagggtggggccaggtggagataattgaatcatgggggtggtttcccccatactgttcttgtggtagtgaataaatctcgtgagatctgatggttttataaatgggaattcccctgcacaagctctgctgcctgccaccatgtaagatgtgactttcttcctcattcaccatccaccatgattgtgaagcctccccagccatgtggaactgtgagtccattaaatctctttcctttattaattacccagtcttgggtatgtctttatcagaggcatgacaactgattaatacagtaaattggtaccagatagtgggacacttctgtaaagatacccaaaaatgtggaagcaactttggaactggataacaggcagaagttggaacagtttggagggcccagaagaagacagcagaatgtgggaaagtttggaacttcctagagacgtgttgaatggctttgaccaaaattctgatagtgataagaacaatgaagtccaggctgacatggtctcagaaggagatgggaaatggtttgggaactggaataaaggtgactcttgctatgttttagtaaagaaactggtagcattttgtccagaaatctgtggaactttgaacttgagagatgtgatttagagtatctggtagaagaaatttctaagcggcaaagcattgaaggggaagcacagcataaaaatttgtaaaatttgcaacccaacaagaaaagaaagctccattttctggggagaaattcaagctggctgcagaaatttgcataagtaatgagcagccagatgttaatcaccaagacaataaggaaaatgtctccaggacatttcagagactttcacagcagcccctcccatcacaggccctgaggcctaggaggaaaaagtggtttccagggccaggtccagggcacccctgctgtgtgcagccttggaacttggtgcccttcgtcccagcccctccagccatggctaaaagggaccaaggtacagctcaggccattgcttcagagggtggaagccccaagccttggcaggttccatgtggtattgaacctgcaggtgcacagaagtcaagaattgaggtttgggaacctctgcctagattttagaagatgtatggaaatgcctggatgtccaggcagaagtttgctgcaggggcagggccctcatagagaacctttgctagggcagtgtggaagggaaatgtgtgtttggagcccccacacagagtccacactggagcactgtctagtgtagctgtgagaaggggtccgccatcctccaggcccaagaatggtagattcaccgactgcttgcactatgtgcctggaaaagccacagacgttcaattccagcctatgaaagccactgggagggaggctgtaccctgcaaagccacaggagtggagctgcctaagaccatgggaacccccctctcgcatcagtgcaccctggatgtgagacatggagtcaaaggagatcattttggagctttcagatttgaccacccctctggattacaaatatgcatgggggctgtagccccttcatttcggccaatttctcccatttggaatgggtgtatttacccaatgcctgtatcctcaatgtatctgggaagtaactaacttgcttttgattttacaggctcataggtggaagggacttgccttgtctcagatgagactttggactgtgaacttttgagttaatgctgaaatgagttaagactttgggggactgttgggaaggcacgatgggttttgaaatgtgaggatgtgagatttgggaggtgtcagaggaggaatgatatggtttggctgtgtccccacccaaatctcattctgaattttaataattcccatgtgtcaaggatgaggccatgtggagataactgaatcatggaggcagtatgtcctatactgttctcatggtagtgaataagtctcatgagatctgatggttttattcaggggagttctgctgcacaagccctctttcatgacaccatgtaagatgtgactttcctcctcattcaccttccaccatgtctgtgaggcctcaccagccatgtggaactgtgagtccactaaacctctttcctttagaaattctcaggtgtgtctttattagcagcatgagaacagactaatacagtagtaaatacaccctgaacaattacactataataggacatcttcttttcaagttattctcaaagggcttagaaatgttagcaatcggggaaaatctatgtaaagtgcatatgggaggcctgggtactgttcttttcccacttttattcaaatttgaacttatagtatgacaattttttaaaataaatgtattctggttcaaagtgcccagtatgatcagtcgtagtccatagtgaacagctttcatcacgcttccccaaatattttgaaaacccctttcaggctagacacagtggctcatgcctgtaatctcagcactttgggaggttgaggcaagaggatcacttgagcctgggagttcaggaccagcctgggcaacatagtaagacccccaactctatgaaaaggaaaaaatattttaaaggggaaaagaaaactccttttgtaatttgatagtttcctatctgggctttattctagaccgactgaatttggcattctgcaggaaatgttccagaaaccttcagtcctgagaagcctctcagttaattctgatgaaaattaaattttgagaacccctggccaggcataaagtgtggatcccatgagtaaggtatgtggagatgaaaactaagaagtggtcttgtcacacaagaatacaatctttaattcacatcatcaatgctgtattttcttttgtttcctttattattattattattagagacagggtctcattctgtcacccaggctggaatgcagtggcacgatcatagctcactgcagtctcgacctctctgggtgcaggtgatcctcccatctcagcctcaatgttgtatttgagagctgatttttacagtgagcttaacattttgaagtgtagtgctctgattaattagaaacacagattttcagaccttatcttcactttttaatttttttgagacaggatcttgctctattgcccaggctggagtgcagtggtacaatcatggctcactgcagcctcaacctcctgggctccagtgatcctcccacctcagcctcctgagcagctggaactacaggcatgcatcaccatgcctggctaattttgtgtgtgtgtatttttgccagagaggcagtttcattatgttgtccaggctggtctcaaactgctgtcaagcgatctgcctgccttggcctccaaaagtgttgggatcacaggcgtgagccactgcacccagcttggagtgcattctctcccagttcggcagggccacattccctctggagactctaggggactaggcttccttgcctatttcagcttctggtgcttgccggcaatacttggcattccttggtgtgtagacgcatcactgcaatcaccctttccattttctcataagtggtttccctctgtgcatgcctgtgttcctccttttctttttccttatttgtttatttatattgaagctatgcatgaatgtttctctccttcctagaaggacaccagtcattgcctttagggcccaccctactgcagtaccccttcagctcaagagcctattcccaaatgaaatcacactcacgtatacatgagggttaggactttaatgtgtcttttgtcgggggacacacttcaacccacaccagatggataaagcagaggctttgtgtaggtagaagcagaaatgatgcaattcccattttaggggatgggttcctgtaaatcctgcctgctcagaagggcaaatgtagaaccaacagcagccatggtgacacctggtagacgcggaggccttttggctatcaaccagacctatatgcaagcagtttagttgtccctaaaagactcccccagtttaacgaggaggcatttggaagcaggagaggagagaacttaggcgtgtcttatcaataggattccactgcacccacaaactggtgaagcaaggagagaaagctacagatggaaattacttatactatgatgcagtggtaaacatttgactcaacttagcagaacaaaacccaaatggaaataatgatggtggacacagtgaggtgctcctgtgtaacactgatgcttcttggccagcactgtcctgatcttgccaggagatgccagcagagtgaggttgcgctgccccttggctgggagggagtgcaagacgcatctcaaattcagaagcgttgacaccgggagctctgtggttattttcttccatgctgtggattatcttcactcttttgatagtgtcctttgatgcaaaggattttcaatattggtgaagtccaattactctgtattttttcttttattgcttatacttttggtgtcacattgagaaactattaccaaatctaagacctatctatctggatatctatctggaaagccctttccagagaaacagaaccaataggaaggatagatagatagatagatagataacagatggatagatatatggagggatagatagagtgatagctagatggagggtggatagatggatggatagattgatagatacatagatagatggatataagagagatagatagagtgatagattttggtaaagtctaattactctattttttttttttttgtactggaaggaccagtacattaatataagtcatgacttttggggtatttttttgtggtattttttagagaccagccttgctctgttatcccagctggggtgcagtggagtggttataggtcactgcagccttcacctcctggtctcaagggattctcctgcctcagtctcctgagtagctgggaccaccatgcccaacaaattttttttttttgagacagggtctggctctgtcgcccaggctggagtgcaatggtgtgaggctcactgccacctccgcctcccaggttcaagcgattcttctgcctcagcctcccaagtagctgaaattacccgcacatgccaccacacctggctaatttttgtatttttaggagagacgaggtttcgccttgttg[134 bp omitted]gccacggctggtcttgagctcctggcccaaagtgatcctcccacttcagcctcccaaagtgctgggatgacagatgtgagccactacgaccagacctcattctggtatcattctttgcctcacttcctccagtatgggatcccaaactgcagaggctatggagttagagtgacgatggcagaacttagagaatcagtgcccagctagggcgcttcccagctgtgtgacctcggataggttactcaatctctctgttgttgttgttgttgttgttcttcttcttcttcttttcttctcctccttctccttcttttcaaatttaagaacttctctgtctctctgttcttcttcttcttcttctttttttttttaatgttttgagatagggtcttggtttgttacccaggctgcagtgcagtggtgctatctcagctcactataaccaccccctcccaggttcaagcaattctcctgcctcagcctcctgagtagctgggattacagtcgtctgccatcacacccagataaattttgtatttttagtagagacagggtttcaccatgttggccagactggtctcaaactcctgatctcatgtgatccacccaccttgacctcccaaagtgctaggattacaggtgtgccgtcaacctctctgtttctcgatttcctcctgggcaggatggtattggagtgcccactggtgagatcactgtggggactacacctaacaccctttgaataaggtgagcgggacacacagaaacactgaggactgatggttattcttggtagctcatgatccagcccctccctgtcactccgtacgtactccctggattgagtgtctcacaacaaagacattttctgccgcactgaaatcagatcatggtgtgttttgcctttgagtcattttggactccaaggtaacatgtaagtgtgtgtctatgtaactttccagaaattctttctagaataagctctgctttggactctattttccccctcagggcttccactggatcttccagtccaggaatgtatctgaccttcccaatacattgatgggctttagtactttattttactattttatattttatgtttttttttaaattttattattattatactttaagttttagggtacatatgcagaacgtgcaggtttgttacatatgtatacatgtgccatgttggtgtgctgcacccattaactcgtcatttagcattaggtatatctcctaatgctatccctcccccctccccctaccccaccacaggccccggtgtgtgatgttccccttcctgtgtccatgtgttctcattgttcaattcccacctatgagtgagaacatgtggtgtttggttttttgtccttgggatagtttgctgagaatgatggtttccagtttcatccatgtccctaaggacaatgtcacagtaacctacatgtccactgaaggcctggaagtagtcatctatcttggtccttcatggatttttttgtttgtttgtttttatttccttcaactatttatttatttatttatttttgagacggagtctcactctgtcgcccaggctggagcgcagtggtgcgatcttggctcactgcaaccttcgcctcccaggttcaagcaattctcctgcctcagcctcctgagttgctgggattacaggcaactgccaccacacctggctaatttttttgtatttttagcagagatgggatattgccatgttgaccaacctactctcgaactcctgacctcaagtaatccacccacctctgcctcccaaattgctgggattacaggcatgaggcacggcactcggcctccttcaacgtttattttcagttctggggtacatgtgcaggatgtgcaggtttgttacataggtaaacgtgtgccatggtgatttactgcacggatcattccatcagccaggtattaagcctagtatccattaggtattcttcctgatgctctccatcctcccatccccacttccaacaggccctagtgtgtgttgttccccctgacttgttcattgttctcatccatcagctcccacttacaagtgagaacacgtggtctttggttttctgttcctgcattactttcctaaggataatggcttccaacttcattcatgtccctgcaaagacatgatttcgttcctttttatggctgcatagtattccatggtgtatatgtaccacattttctttatccaatctatcattgatgacatgtaggttgattccatgtctttgctattgtgaatagtgctgcaatgaacatatgtgggtgtgtatgtttataataaaatgatttatattcctttaggtatatacccagtaatgagattgcttggtcaaatgttatttctgccttgaggtttttgaggaattgccacactgccttccacaatggttgaactaatttacacacctatcaacagtgtagaagtgttactttttcttcacaacctcatcgacacctgttgatttctgtctttttaatatgagtcattctgattgacatgagatggccctttgttttgtttgtttgttgcttttgtttctgtagatacagggtctcagtatgttgccctatctttcacagagacagactggtcttgaactcttgggcacaagtgatcctcctgcctgtttctcaaggtgttggaattacaggcaagagccaccatgcctggcctccactctggctcttttgtcttgaagaaagagtaaatatttctggcttcctctaaagctggaatcagctctttaactgaactagaatactcatataggcacttttcactaaaattatttattgtaagaaataagaaaactagttgaattcctctaagctcctatttatggtctaaaatgtcattgagaatattgttatgttgttgggaatataatcattaaggattattcttggctgggtgcagtggctcacacctgtaatcccagcactttgggaggccaaggtgggcggatcacctgaggttgggagttcgagaccagcctcgccaacatggggaaaccccgtctcaaaaaaaaaaaaaaaattagccaggcgtggtggcacatgcctgtagtcccagctacttgggaggctaaggcaggagaatcgcttgaacctgggaggcagaggttgcagtgagccgagattgctccattgcactccagcctgggcaacaagagcaaaactccatctcaaaaaaaaaaaaaaaaaaaagaattattcttatgtctgcagtctgcatagtttgcatgttatttattgaaaaggcaaatgcaagtatatataagtctaacagtgtcctaaaaagatgctcatttttttgtaacttttaactggagttatttttcactaaatttctcatatatgcatcttgtcgtactactcttacccaaaacaaccccactctcccccaaccacagttaccacacacataataaga[131 bp omitted]atacaaaaaattagccgggcttggtggcacacacctgtagttccagctacttgggaggctgaggcaggagaattgcttgaacccgagaggcggaggttgcagtgagctgagatcatgccactgcactccagcctgggcgacagagtgagactccgtctcaaaaaaaaaaaaaaaaaaaaaaaaaagactttaatcaatggtgaaaacaaatgagaatgtcttgtgagaaaagtgcttcatgaggaatgtctaagctaatctcgcatgaagcacgtctcgatacttccacatataaatgcaggtaataacgttcacccacctcagaggagagtgttgaggttgaggctttatgatgcactgcttgtaagatgcatttagacccaaaggtggaagctgtactgtaaagtctgcagtcatatttcaaatgctgaaattcaccctgttagaattctcttccctcttcacttccttttaagcccaactgtagctcttggttaacttttctaaaaaaaattatcttcatggaaagcatattcaattttatagaattcccttcattccatatgtatgagtgtcagttgaaaggctgagataaattattcctttcttaaataactatgtaatagctgtcatggtaggttatgtttaatataaaaataattggtagactagagcagtgtccagcctcggcacttaatagatatttaattataataatgacaagagcaactaaggactacggcaggatcttggaattgtagaatcagtgtctgcaaatgcaggagctggggaatcaacttattgtaagtaaggaaaatacgttaagtttcctgtaattgcagttgggcatacttaaaattttaggtaaacaatggggttgagagtgaagagttgagtagttgttttatctagttttttttgttttttgtttttaacatgtttccaggtttttatctaaatgggctaatacagtacatactgttctgtgtggcttctcatgacatccatgaatattttgcctatatcaatagttgattcctagttattttcgagttgacttctattggattctggctgtcccggagtggattttccactcacctgtgagtggatgaacactttgggtgtcaaatcatattttccgtagtggattttatagccatcggtggcattcctatttaagactagtgatgctaatttcaggaagagaagagaaccaaatagacatatccaagaccacagaggtagattgttttgtggttgaattaggaagtctacacaagtaagtgtgaatacccaaaggcttgtattttatttttaattctctaagagggtatttgttataatatctgaaggggattatgcatctcatagcattgcaatgaataaatgaatattgtattttcttcactttttaaaaaatccaatgttgacttacattgtataatatacaaatttttgccactttatagagcagacttccttatgttacatttactttcatactgggtatattttattttactttattttttattggtagcgtctttctgagtaaaaaacaaataatgaattggtaagatgtatctcattcaatgtaagaacctaatggttagaaaagaaaaagaaaggtttttagttacttacttatagtttttctatactgctgagtatttttctttctactttataataataacattccaagaattattgaatatcagaccatttgtgggaagtttgggaatgtgtgtaaatttctttagaaatctttaaaaattacttctatgtgtaggtgagaaaccgcataagaaagcagaaatctagtaacaagtttcttccagcggtgaatgagtaaaataaaacacataaggcactgctaagttttaattatttaactattttaattaaaaaaataagatactatcagctaaggatagcatagcttatattccaaatcaataactctttgaatgagaaagccagaattttgattcattaatatacaatgcagcatttggtgtcatccaagaagatacttttcataagttccccctattctagttgcaagtaccgtttggtgtctttattcttttctttgagagagggtctcactctgtcgtccagcctggagtgcaccagtgtgactgtagctttctgtagcctcgacctctggggctcaaatgatcctcctgcctcagcctcccaagtagctgagactacaggtgcacaccaccatgcctggctatttttattttattttgttttatttcttagtagagacaaggtctccctatgttgcttaggctggtctcaagctcctgggctcaagcaatcctcctgcctaggccttccaaagtgctgagaatacaggtgtgagccaccatgctggccctcttattctagttttaccataactagttctagtctataaattcccattattttagctttgtttcactgtgaggaggcggtcattctgttcccttggaaacccttggccatgtctggagacatttttgttgtcacattggtggggcgtgggtggtcctggaacctggtgaatgaagctcagggacgctgctcaacaccctacggtgcccagggctgcctgtgtcctccagaaaaaaaaaataagctcttttcttccattccctatacccctgaaaaacgcgcagtcctacacggaacccacagcgaattttcaccaagcacgtggccaccaagtcatccagctccaaatgtcagctggaccaaggtggaaaaagcctggtccagtgcattttacccagatcttcaaagctcctctcacccttgtgtctcccccatccgtgtggagctttacttctgtatagatcctcaggaatcgcctctgctcttgctgcctttacagactccctctctaggtttgtgtcctgagccaagaaaggaagaagaaattccagtgaaaagtgtgacaaattacatttctccacgttaaaggattcaaccaactgttgaatcctgatgaattttgtctgggttgtgattatgtcttagactttcttgtctaaactctactatcatcaagataacttggtgaaaattcactgcaggtttcattcaggacagcacagtttgcaggtgtatagagaatggaagaaaagagcttatttttttttatctggagaacacaggcactttcaagagtagcttcagtgcctataatatttttgttaatgaatattaatggagtattttaatgaatgcagagactgctttggattttattagttgaccttaaacagcactttgctcatgcagcccaatttacctacatagacctgggagcactgatgttattaccatccttcgtcattgagaacagaaaggttaagaaggtgatgtccgggtagtgttgctgtttcctgagatgaaaggtctcataaaagtaattattgttttggtttcacctgcggtggggaaatgccttgtagaattatacagttctaccatcaaagtgacccaggaaaccgaagtgactgagggcatctctcttgttattttaattttaaaaattttacatcttaggccagatgtagtggctcatgcctgtaatcccagcactttggaaggcagaggcaggtggatcacctgaggtcaggagttctagaccagcctggccaacatggtgcaaacccatctctactaaaaatacaaaaattatctgggcatggtggtgcacgcctatagtcccagctacttgggagggtgaggcaggagaatcccttgaacctgggaggcggaggctgcagtgagccgagatcgcgccactgcactccagcctgagtgaaagagtgagacgccatcccccccaccaaaaaattacattttaattgataaatcatatttatacatatttttagggtacatgtgatatttttatacctgtatacaatgtgtaataatccaatcagagaaatcaggatatttatcacctcatttatcttttctttgtattggaaacattacaattctttcttctagctattttgaaatatgcagtaaattatctaatctccctattttattttttatttttattttattttgtaatttattattattgttttttcataatagaaatggggtttcaccatgttgcccaggctggtctcaaactgctaagctcaagctatcctcccacctcggcctcccaaaagactgggattatagacgttagccaccatgcccggcatatttttgtttcaataaaatacagccaaggtttcactatgttgcctaggctggtcctgaactcctgagctcaagtgatcctcccaccttggcctcccaaagtgctgggattataggtgttagccaccatgcctggcctatttttagtttaatagaataaatagagagaaggtctcactaagttgtccaggctggtcctgaactcctgagctcaagagatcctcccacctcggcctccctaagtgctaggattacaagcgtgaaccaccacacctggccccagtctccctattttaaaggaaacagcattccagattcagtacgaagacttgcaaaagccacatattgaattaatgtgaaacaggcatcatctctggtttttttttttaagttaaattttaaacaactattatagataaagctcaacttggccaaaacctgtcttcaccactgtggctcctgactttacctgggggttgcaattcctatgagccttttccttccagatatctgccccactttgataaacattaatgaaaagggaaatgttgatgtgtgaatgcgttaaataaaaggtatcatactgtatatattttcagaaaacttatttaaattgaaaaaatactgtactatgtatcttggaaatctactgctattactagacatagaactatcttactcttgatctgatgcatagaatctcatagtaggaatatacaccaatgtatttagccaatctacttcaaagaggggagatttcagttggtttcaatatgactctacttaaagacaatgttggatgaaacatccttcctccatcctggctccctgcactgagtgtggggctagaagcacgagtgctttgctaaaatttaggctcacttttaagtcttgatatttagtggcaactgaaggtaacttgctgtgaattcttcttataacatatattttcacactttaaaagtttttggtgttttgatagtgagccattctatctcattatccttaacatttactttttctagttgatgggaaagttaaaaatattttatgtgcctattgataatttgtaatttttggggtctcttttctaatttatttatcgaaaatatggccaggtggagtggctcatgcttgtaatcctagttcttctgttcctggaccaaaccgagggtttggctgctatttcttgcggctcaataatgagatgcagatgaactgagagagaagggagtttttatttctgtaaccaggtacagggagaaggcctagaaattattgccagaccaactcaaagttacaaagttttctagagcttatctacctgctaagcaatgtgtctatcagtaagtgtgcactcatctaaagacattagtgatgaacttcttctaatctagaacaaaggtctgagtcctgaagaccttcctctggagcctcagtaagttcatttaatctaaatgggtccaggtgctggggtgattacccttatcttgtctctcgctaaatcatggaggtttgaggagttctttcagaccctctataaacttgtttgtggaggtctggggagtttcatcagacccccaataaaacctgtttaatcctaaacgggtcctgttaagaatgccttcgttgtcttgtcatgcttcaaggcccaggagaggcctgggcagaactcttggtgggcttttgtgagattccagcctttgtataagggcgctggctctctcagcttttaatattgaacttcaccactcggtcagtgctgaaacagatgtcatggaggcctgcgttagtgagacctggcctgccacactttgagaggtcgaggtgggaggatcacttaaggccttaaggagtttaaaaccagcctgcaaaacatagcgagaccctatctctacaaatagtaaaaaaattgccaggcatggtgcacacttctagtcccggctactcaggaggctgaggcagaaaaattgcttcagcctatagttcgctgtgctccagcctaggtgacagagcaagactctgtctcaaaaaaaaaaaaaaaaagggaaatgttacagagattttttccttccctgtaactcctttttgctttgtcgatggtctataaaactgttttcagttatttatattagtttcttgtggctgctgtaacaaaataccgcaaactgggtgacttaaaatgacagttattctctcctggtactggggaccagaagtctgagatccaggtgtgggcagggctggttcctcctaaggcctctctccttggcttggagatgctgtcttctccctgtgtcctcacatggccgtccctgtgtgtgtgtgtgtcctcatcttctccctttataaggacaccagtcagattggattagggccagccctggtgatctcattttaccttaattatctgtttaaaggccctgtctttaaatacagtcacatcctgggggactaggagctaggatttcaacatataactttttggcagacacaattcagcctataagagattccactccttatttaatcagaggaatttaaagatagctactttaaagtcctatcctggtcgggcacagtagctcacacctgtaatcccatcactttgggaggccgaggcaggcagatggcttgggttcaggagttctagatcagcctggcctgcatggtaagaccccatctctacaaaaaatacaaaaattagcctagtgtgatggcttgtgccagtggttccagcgactcgggaagctgaggcaggaggatggcttgagcccaggaggcagaggttgcagtaagccaagatcccatcacttcacactccagcctgggtgacagagtgagatcctgtgacaaaaaaagtaaaaaaggaaaggcaggaagacagggaggaagggagggagaggagagagaaaaagaagaaaagaaagaaaggaaggaaggaaggaaggaaagaaagaaagaaaagaatccactgcactccagcttgggagacagagccagactgtctcaagaaaaaaaaaaaagcacgaaacacaacaacaacaaaaaacagatgactcaggataagattctttccctttctttctttctttctttctttctttctttctttctttctttctttctttctctctctctctctcctcctttccttccttcctttcttccttccttccttcctttctttcttccttcctttcttttttgtcacaggatctcactctgtcacccaggctggagtgcagtggtaggatcttggcttactgcaacctccatcttgtgggctcaagcaattctcctgcctcagcctcctgagtagctgggattacacgcgtgtgccaccacatccagctctttttttttttttttttttgagtagagatggggtttcaccatgttggccaggctggtcttgaacttgtgggctcaagcagtcctcctgccttggtctcccaaagtgctgtgattacaggtgtaagccaccgcgcccagccgctgagtcatctgctaattcactggacttctgcacaaataatttccctcattcattgctgttggctgaccccaactgtgtggtgactccataataggccatcattaaccatcatcaaattccctgtgtcctggctggtgacatctcactccagtcttataggtgtttctctggcaccctcagatgcttccagcattgacattgctagctactgtgggttcccatctgtcttccttctcttctagagcatgactttaaaaaaacaaaagaaaacataaacaaaaacaaaaaaccatatctttcttgtttttaaagcatgactgcgctcttgcaatctttgtctaattctgtgactttggcccagccgtgttcaaagtccaccattctgaaatggaacccagaatttggttttgtgatgtttgatctttcttcttctcccttttcccactgtagtgtttccttctgtttttttttttttccacttaagagtctcaatcaagttgatgatgtgtagacagtcctcagtgaccatttattttattttttagtataaagtaaagggctacaagtgcggctatgttgcatggatagattgcacagtggggaagaccaggttttcagtgaatacatcacgaatagtgtacattgtactcactgagtaatttctcattcctcatcaccttcccacccttctgagtctccagtgtctattattccactctctatgtccatgaggacactgtgtttagctcccacttataagtgaacatgcagcatttgactttctgtgtctgagttatttcacttaagataatgccctccagctccatccatgttgctgctaaagacttgattttattcattttttctggctgagtgcatgtgtgagtgtattatataaactggatatacacagatatatatatatctcacatttatttaaaaacacacagaatggccagatatagatatatgtatctcagatttcttacatatataaatatgtgtgcgtgtgtgtgtataatctctcattttcttttaacttttaatttttattttaagttctggggtacatgtgcagcatgtgcaggtttgtcacataggtaaacgtgtgccatggtggtttgctgcacttgtcaacccaccacctaggtattaagcccagcatacattagctatttatcctaatgctctccctccccctactcttaccccccaacaggccccagtgtgtggtgctcccctccctgtgtccatgtgttctcattgttcagctcccacttataagtgagaacatggggtgtttggttttctgttcttgtgttagtttgctgaagataatggcttccagctctatccatgtccctgcaaaggacatgatctctttcctttttacggctgcatagtattccatggtgtataagtacacactttttaatccagtctatcattgatgaacatttgggttgattccacatctttgctattttaatctcacattacagtcatggctacgggcagcagagtgagaccctgtctctaaatgaataaataaataaataaaaataaccttgattccttgctagttggagagaacattgcactggtggctaggaccattcatggtgatccttactaatcttgtcctggagagatgcttattaaaggagggtggaaatggctaaatatggtgaataaaaagacgatattctcaattcatccatgtttctgtctctgtctcacctaactattgggaaactctggattttctcggtgtgaactttatgggaatactaaatagtatattaggcagtggagttacagacatgagaaccagaatgtgatattttttaaatgtcacattgtgggcaagtctaatatagaggtattaattggaagttgtggggtagagaaaatggaccactaaacggttagaacgtgggcttcaccaaatgccccaaggtagttagtctttaaggatattacatttgagagccatattggagggttgaagttgagaagatggcctggggaattggctaatttacacacacacacacacacacacacacacacacacacacacagactcctgagaatcagtccttattttgaatcccagctcttcaatttaccagccttgtgaaagtcttttaagcgatatgaaacccaattgcttctcctagaaaacggaagagtcatcattaaccctttgaggcaagcggggtgagatattttgaggatcaaatagtaacaagtgtgtggaaatgcctggggaattataaagctctgctaacattatggcggtgctattaatctttattatatattatttgtcttgtggggcagttcctcagcctataaagcctcaccaacttggaatcacttgaggattctaggcagggaaacaccagattgtaccactggttgcattcttgtaaaaatatcttaattacagctgctaaacatgtcttcctccaccaaacaagtctggcctccatgactatcacaggtctatggtgtttcttgttgtgctttttaaggtagataccacagttgatccagtatgtgtaaaaacaaagtgctttccagaacagtaccacacataaattagatctgatacaaagcagttattgaatatatgcacattcattgattactgatttactttactgacaccagaatagtaggtttttgttgctataccaacgtaatttcttgtaactctgccattagaattaacctgagctgcatagaccatgcatagaattttgccttattctttgtgagcaaatatcacttatttgcaaatacgtttaaagaatgtgctgggctggccaggcacagtggctcacacctgtaatcatagcactttgggaggccgaggcgtgtggatcacttgaggacaggggttcaagaccagcttggccaacatggtgaaaccctgtctctactaaaaatacaaaaaattagccgggcatggtggtgcacacctgtggtcccagctatttggatggctgaagcatgagaattgctagaatctgggaggc[133 bp omitted]ggaccattatctgcctagctatgaggaaaacatttgctttgcagatgctcttattttattcttctcttccttagataatctaagaagaagccatgaagcaattgctgtatgactggtgagctggcaaattcacgaacattcatcactctccatttctagagagaaggattctttgtcaaggttttctctatcctggaggacttgggttaaatatgtgcttaaaatgtcctttatgagggtggattatcaattattcctcatattttattcaagctgtgctttctattttttgtcttttatttatttatgtaatttttttcttttttatagagattgggtctcactatgttgcccaggctggtctcaaactcctggactcaagggatcctcccatctcggcctccctaagtgctggaattagaggcatgagctgctatgcccagcctactgtctatattttcaagccataactaaattcacactggtttatgatgttcatatcatctttgtggatttgtatttttattattctataatagtcttgccattctatattaatgatttttcaattgtaattttcttctggctgatgttattattgttacaagtttcttttgattactacttggctggcctacttagatgtttacatctttttagtttcaagttttgtttgtcattaggttttaggtgtgtcctttaagaaagacataggacagatttttaaaaattagtatgggattctttaataggcaggtaaacccacccacatttgttataaatattaagatagttgatcttatttctgtcatcttacatgctatcttatattttcaagattctcctgtggttttcttttttcccctcttgctttttacgggctgcattaagggttctctgtttcctggctgatatggtttggctgtgaccccacccaaatctcaggttgaattgtaataatccccacgtgtcaagggaggagcccagtggagataattgaatcatggcagtggtttcccccacactgttctcatgatagtgaatgagtctcatgagatctgatggttttataaatcggagttcccctgcacaagctctcttgtctgcctccatgtaagatgtgcctttgcttctcctttgctttccaccatgattgtga[174 bp omitted]gtggtgggcgcctgtggtctcagctactcgggaagctgaggcacaggagaatggtgtgaacctgggaggtggagc[132 bp omitted]cactggcccatccttctcccctcaagtggcctggtaactgtacctcatgtttcccttaatcatattaacatcattattaacttaccaaaatatgatggttaatctctatttccagcttccttttgaagaaaggaaagactggagaatgtttgaacactacagtcctaccccccccgccccaccttcctccatgtaattaccgcttagtgaattatttactcctttccaaaataataataattaataatagtttctgtcaatgcgtatttaatgttatcaacatgttttatctcttttcaacatcttttcttatgtctacccttttatttttatttatttatttttgagacagagtcttgctctgtcacccaggctggagtatagttgtgtgatctcagctcactgcaacctccacctcccaggttcaagcgattctcttgcttcagcctctctagtagctgggattacaggcacatgccaccatgcctggctaatgtttgtatttttagtagacaaggggtttcactatgttggccaggctggtctccaacatccaacctcaagtgatccacctgcctcggcctaccaaagtgttggaattacaggcatgagccactgcacttggcctgtctactctttctttctaagataagtttgccttttgctgaaaatattccttagtagattttcatcaagagtttttgggttcatgtacaatccaaatgcctgtaatccctattcattcttcaatgatgtattagaagggtttggaactctgagttcagagtgacttttgtctcagcactctggaagcaatggtccctggtcatcaggcatccactgtggctgttgggaagtctcttgacattccagttatcctcccattttaggttatctgtggttgtgtttaaaccaagtgcctctgtctccatcattgccctttactgagctaggtctaactggaggtttttaatttttttaactgggttcagtctgaaaacttatgtctgtcttcaatcctgaaaaattcttagccaagatatctttcaatgtatcatctccctatcctcatccttaaaccctcttaatagtaggctgggactttttgtccaaaaccatagaatgtacaacagcaagagtgacccttaaattaaactatggactttgggagataatgatttctcaatgtaggttcattgattgtatcagataatgtaccatcttgttgccgggtgttgataatggaggaagctattacatatgtaggggcaggggatatgtgggaactttctgtacctatgctcaatttttctgtgaacctaaaactgctctaaaaaataagtctatttaaaaaaaaacatgagcttgagatttaataaaataactactattaatatttaaaaaagaaataggtcagacactgtgcctcacacctgtaatcccagcactttgggaggctgaggtgggaggattgcttgagctcaggagttcaagaccaacctggccaacctagtgagacccccatctcaatttaaaaagtttttaaaataaaaatataaacatgaaatagaagggaagatggatggatacaaaaggatttatgatataatatttgaggttgaattaggaggacttggaattgattgaatggaatttggagttggggaacctgactgaggggatattggtcttcaattcatagtgatcatttttgatcaatggctgttgtgaatatttcaggatattgtacaattcagctgttac[132 bp omitted]gaaccccatctctactaaaaatacaaaaattagccaggcatggtggtgcacacctgtagtcccagctactcaggaggctgaggtgggaggatcgcttgaacctgggaggcagagggtacggtaagctgagatcgcgccattgcactccagcctaggtgacagagtgagagactccgtctcaaaaaatacataaataaataaataaataaataaaacttagtagatctattccaacattgacccattgaaaaataaaataaaatttagtaaaatctgcctttcattgaactaattgacaaaaaaaatttagcagaatctcaaaaatgttaaattttctttcatagattttaaatgatttctagattgtttttgaagtggaattttttccacctgatttcttctatggacatatgttcttgatgaaccaaaggagaaaacagtttctatacacacatgtgttccatccccaaatatcagtgtttcagcatctagttctgggcttagatctaataagttactggagcttctgttataattgcccccaccccgctccatgtggcttagagaaaacctttgaggttataaaatgtattaaaaagtacaactgaacacttgaaaaatcaaaactgactcgctcttagtctctgattttccattttgcttactttttttttttttttttttttgagagagagaatagtttaataaagctctatcagccaggcgcggtggctcacgcctgtaatcccagcaccttgggagg[136 bp omitted]gaggcaggagaatggcgtgaactcggga[133 bp omitted]aaagaatacgtgaatactgacagagttaaaccttggaaagtttcttttctaaaaaggaaactttaaaagtttttatttttaattgacaaataataattgtttataggctgggcacgatggctcacacctctcagcacttcaggaggccgaggtgggaggatcacctgaggtcaggagttcaagacatgcccggccaacatggcgaaacgccatctctaccaaaaaaaatacaaaaatcagctgggcatggtgccacacacacatacacacacacacacacacacccctataagcctcataaatatgaacaattattattattttttgagacagagtctctctctgttgcccaggctgcagtgcagtggcgcgatcttggctcgctgcaacctccgcctctcaggttcaggcaattatccctgcttcagcctcccgagcagatggtattactttttttttttttttgagacggagtctcactcttgctacccaggctggagtgcagtggtgcaatttcagctcactgcaacctccgcctcctgggttcaagtgattctcctgcctcagcctctgaagtagctgggaccacaggcgcgtgtcaccatgcccggttaattttgtatttttagtagagatggggtttcaccatgtttgtcaggctggtctcaaactcctgacctcaggtattccacttgccttggcctctcaaagcactgggattacaggcatgagccactgtgcccggccttggttacatttttattcaataaagtaaacaaaaaagttttttttgagatagggtcttgctctattgtctaagctggagtgcagtggtgcattcatagctcactgcaatcctgacctctcaggctcaagcaatcctctcatctcagcctcctgagtagctgggattataggaatgcatcactatgcccagctatttttgtattgtttgtagagatggggtttcaccatgctgcccaggccagtctcaaacttctgggctcaaatgatccacccgcattggccttccaaagtgctgggattacaggcatgagtcacagcacccggcaaaattcaatttttagagcttaccctcaactgtaacccctgttataaattttaagcctctgatgtcactaaaacaatatcaaaagatgttataagagttaaacctcatcatgcttgcaaaatgaattggtaaaatatgatgccatattcgtatagaacaatggtctccaacatttttggcaccagggtctggttttgtggaagacggtttttccacagacaggaagggggtgcaggatggtttcaggatgattcaagcacattacatttattgtgcactttatttttattattattacacgataatatataatgaaataattatacaactcatcgtagtgtatgatcagtgggtgccctaagcttgttttcctgtgactagatgatcccatctgggggtgatggaagacagagacagatcatcaggcattagattctcataaagagcacacaacctagatcctttgcatgcacagttcacaatagagttctcgctcctatgagaatctaatgctgctaccgatctgacaggaggtggagctcaggcagtgatgcaagcaatggggagcggctgtcaatacagatgaagcttcactcatttgcccaccactcacctcctgctgtgtggcctggttgctaacaggctacggaccagtactggtccatggccaggggattggggaccccggtatagaacattagtttttgttgttgttgtttaatctagtttctgagtaagacaacacaggtacgttgtacagtgagaactgataacgaatatcactgtttcatatgttaagttatctaaaatgcaaatgttaattgatagtgcctggttttttgcttgcttgtttgtttgcttatttctaaaaatgctttcaggagctgctggctgtcagtgtccctgtgctgtttgttttgcggtgttgatggcacatttatgacaagaaacgccagacccaacattgtcctgctgatggcagatgaccttggagtgggggatttgtgctgctacggtaataactcagtgaggtaaagatggactctgaccccctccctgtatgtgggagtctcccttaccacagtgttcacgtctttgccgttgcagagaagggtttctggagagaagtcattgtctgatgttatcggcaggaatagcagaggtcactggggaaaattgcaaaatgtcaggagaccacttaacctcccagtttccttagattctagctgttggtggtggcgttttcattgttgggcaaaatttacatttaaaaattggccttttttgatcaggcatggcggctcaagcctataatcccagcactttggaaggccaaggtgggagcattgcttgagcccaggagtttgcgatcagcctgggcaacacagggagaccccgtctctacaaaaataataaaaaaaaaaatctactgggacatggtggcgtgtgtctgtggtctcagctactcaggaggctggggcaggaggattgcctgagcaagggagattgaggctgcagtgagctatgatcccaccactgcactccagcctgggtgacagagggagactctgtttaaaaaaaaaaaaaaaaatcaccttttaaccattttaaagtgaacaattcagtggcatttggtacattcacagtgttggacaaccgtcacccccacaaagaagacccccatttcccatcctatccccatgccctgttaaccacaaatgtaccctctgtctctatggatgtgtctcttcttagaatttcatatacaagtaatcatataaagtatttattttctcaggctgccgtgacaaaggtccacagactggttggcttagataacatcagcttattctctcacagtcctggaggctggaagttcaagatcaaagtgtgggcagggctggttcctcctgaggcctctctcctgtccttgtagatgccgtcttctccctgtgtcttcacagggtcgtccctctgtgtgggtctgtgtcctcatctcttcttcttatgaggtgtcttagtctatttcaggctgctataaaagaataccatagactgggtggcttagaaacaacagacattgattctcccacagtcctggaggctggaagtctgagatcaaggtgtctgcagggctggttcctcctgaggcctctctcctgggcttggagatgccgtcttctccctgtgtcctcacagggtcatccctctgtgtgtgtctgtgtcctcatttcctcttcttataaagaccccagtcctattggataagggtccactttaacgacctcatgctaccttaatcacctctataaagactccatcttcaaatacagtcacattctgaggtcctgggggttaggacttcagcacaggaatttgggagggacacaatttagctcataacatatggtaagtggtgtttggtgactggcttctttcacttagcgtgatgttttcaaggttcattcatattgtagcatgcgtcagcacttcattcctttccatggctgaatactttttcattatatacatacaccacattagtctacagttttaaaaatatcttccttgaattacttctaaagtctctggtacccggggctctttatttctctactctctatcgatagaccaatctggctcttgtaaaaatacatagcatcttttagtgtggatttaaataacattgtttcttcttggaatgcagatcacagtctagtcctatatcttaagcatatatttgttgattgaaaggcattggtcttcttcttcttattttctttctttctttctttctttctttctttctttctttctttctttctttctttctttctttcttccctttttcttttcctttctttcctctatctcttttttttccttttatttttaagacaggatctcattctgtcatccagactggagtgcagtggcatgatcttggctcactgcagccttgacctcccaggctcaagtgatcctccctcctcagcctcctgagtagctgggactataggcatgagcccccacacctgcctaatttttgtggtttttcttttgttttgttttttttttgttttttgtttttgtagaggtggggttttgccatattgcccaccctggtctgagctcaagtgttcagcccctcttggcctcccaaagtgctggggttacaggcgtgagccatcacactcagcctccattatcatctttctgtgggattatggaaaaaaaatgttgtacccatgggatcaagattggatatggtttagcttttaggagaacaggcacgtcttttttttaacctataagttttacaaaatttttgcaatgtattagacaaacaaaatgggaaataaattaaactccaaaatgtcacaatttggtcataaaataggtcaattttaccgtaagatatatattaatgggaggctgaagtgggaggatcatttgaagccaggagtttgagaccagcctgggcaaaatagcaagacatgtatctctgcataaaattttaaggccaggtgtggtggatcacacctgcaatcccagcagtttgggaggctggggaaagtggatcacttgaggtcaggagttcaagactagcttggccaacatggtgacacctcatctctactaaaaatataccactgggcgtggtggctcatgcctgtaatcccagctagtcaggaggctgaggcaggaggatcacttgaattgggaggcagaggttgcagtgagctgggatcgcaccactgtactccagcctgggtaatagagtgagaccacgtctcagaaaaaaaattaaattaaatacaaatttaaataaattagtagggcatggtagcgcacacctgtggacctagctacttgagaggctgaggtgggaggatcacttgagcccagggaatttaaggttgcagtgagctataactgcaccactacactccaccctgggcaacagagcaagagactgtctcttaaaaaaatatgaaacacattaaaattttacttaatctaaattacccattaattttaggtccttgataagaagaaattggctaatttttccattgaaatacatttttttctcagactcataaaactgtataccgagtgacctgtattcatttgtaatagttttgactaaagatatattttaaacttatgtttccatttgcttctaaccatcaatgcatataaggaaatagacagattaaagttttaaaaagatggattttaggtttaccagaaatagagtcaacttgacccaaaatagaatagctttgatccttgatcattgtattgagaatttttagaaactcacctgctgaattcttctttggtctgcagcacacctaatattgaccgcctggcaagtgaaggagtgaggcttacccagcatctcgcagctgcttccatgtgcaccccaagtcgggctgccttcctgaccggccggtaccccatcagatcaggtgaggcaataaaaaggcagcaacatttcagtctcaccagaatgcattctaatgattagtttttgcaaatctttataagaattctcaaaaggtcactcagagtattagggatctaaattcaaaggtggttgttatccctgggcagcttaaatatgtgtgcctctcaccaggtaccactgcacctgctcatctctgtgcatatagcgacagggtttaggcctcttgggggcaatttgccaacttatggtcaacactcccattttcaggtacttgtgctaagatttctcaagagacccctgatgtctttaagctagcagagaccatgcagtggttctgagataagtggatcaaatccacctctgtggatgagattggaaaactagacacagttgggaaaaaaggtataactgagaaaacaaaaaggaaatgaaacttttacatactcccttacttgaccccatcatttcaagatttagacttaccaagttgatataacgacaattaaatgtgttcctttgctgcttagcttaggatcaatacctacaaacatccactcaagatcaatattatgaacaacaatttttatacccagctaaaatatagtggtgcccttagacactattgaagtgttcatggttatcagactctatgtgaaatatcgtgtcatgctgttgcattttgtttaattctagtatttgcttgtcataattttagtatacctgccttcacagtttaatttttcagtgaaaaatttttctgtatgaattttcttcctcctaagtagtagattctcatccaatacattcaaggaatgaactaattaggttaatgagaattatactaaaattaagagtaaacattaaaagtttttgtcccataaatattgatttattattatctttttttgttgcctaatgaccttctttcataattcaaggttctccattttgttcaaaatagtttggtttctagataagcagtctctatataacacagtaccgtgtatgaagagggataaagatatgaatttgtatgagtttccaaaaaaaactacacttataatttcaggatttcaggattttttctttttttctttctttctttttttttttttttgagacagactcttgctctgtcatccaggctggagtgcaagggtctgatctcagctcactgcaatctctgcctccctggttcaagtgattctcctgcctcagttcctgaatagctgggattacagtcatgcaccaccacacccggctaatttttgtatttttagtagagatgggatttcaccatgttggccaggctggtcttgaattcctggcctcatgtgtgatccacctgccttggccacccaaagtgttgggattacaggagtgagccaccatgctctgcctaatttcagggaattttaagtattgattatggtgaaataaaatttatttttaaaaattaagaaaaaaattaggtgattggtggagagatttcaagtcattgccatgtgtatatttttaatcatttgacacaaacggttcagtttaattcattctacttatcaaaaatttcagcaaaacagttcaacagcaagataatggtctaatgcttcccttaataaaactgtttctctttcctatcaatgacactatctagagtctactttcttcttcttccaaggtaggatccttgaaatatacttttttcttttgagatggagtttccttcttgtcacccaggctggagtgcaatggcatgatctcagctcattgcaacctctgcctcccaggttcaagtgattctcctgcctcagcctcctgagtagctgggattacaggtgcctgccaccaagcccagctaatttttgtatttttagtagagacagggtttcaccatattagccaggccggtctcctgatctcaggtgatccaaccactttggcctcccaaaacactgggattacaggcgtaagccactgagcccggcctgaaattatcatttatttatttcttgctgatcttcacttgtggttttcttgtgaattccttttaaactataggtgtataatattgtccaccagtataaatctacataaaattatatggaggccaggcacggtggctcacatctttaatcccaacactttgggaggctgaggtgggtggatcacgtgaggtcaggagttagagaccagcccggccaacatagtgaaacctcgtctctactaaaaacacacacacaaaaaatagccaggtgtggtggcacacatctgtaattccagctagggaggcggaggcacgagaattgcttgaacctgggaggcggaggttgcagtgagccgagatgttgacactgcactccagcctgggtgacagagtgaaactccatctcaaaaaaaaaaaaaaaaaaaaaaaaaaaaatatatatatatatatatatatatatatataatatatatatgtatgtgtatatacacacacacacatatgaaaaagaaattgtcactcctacacttcttcatttcagattctcaaggatacttttaaaaatgtatttatacccagctaaaatgcagtagtgtcctcagatactattgaaacattgaaggttagcagcctctatatgaaaaactaacgaaggttatttgttgttagtctgaaattcaaatggatataactaagtgtcccgtatttattctggcaaccctaattccaagggaatgtttgcatttagcaagtgaaaaaaggagggtcaaggacgtacagccagaaagcaacagaaaacttggggaagaatggctttgaggaggtgcgggaggagaggactttaagcatgtcgggataaattcggtattagcaaagactatggtgctaacttattgacttctgtgaatttagggatggtgtctgcctacaacctgaaccgtgccttcacgtggcttggtgggtcaggtggtcttcccaccaatgaaacgacttttgccaagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgagataagacacttggagaaggaaatgatcacacattgattgagcatgtgtagaatcgagggcatagtattggaaaaacaatgagaacagaaagcaaacaagtgtatccaaagttgccactaaaatggaatgttgtgttggagggatacgatgtttgtgacaccattattagcagaaaaaccagtaaatttgtagagaagtactgttgaaatgggaaacttacagcattaagagttgtcaaatggaggcaattgctggtcgacttagatcacttaatattctatgcccttttggcgggggtgggggtttggggcggggggacatgagcttgtgagggagcctttcaccgaaaaataagtttgtagaattccagtcctagaagatagtcctctaagaataacttgtgtgatcaaatccttttgggaaatgctactcaaaagcattgtacggtccactatttttgaggattcctaatgtgaattgtaagccacagctccgagatatccccagttaaaaaaaaggttaagaaattttctatcagtagggcatgtattcccatgcaactcccagcagcgtcctgtgagtgggaattctctagattagctttgagcagcgttcttacatcattagagcacgggattcagatctgactctgctattattcattaatgtgactcaggcttctgaataaatctagatagctgggcacagtggctcagacctgtaatcccagcactttgggaggctgaggcagaagaaggccaggagttcaagaccagcctaggccaccatagcaagaccctggatctacaaaaataaaatgttaaaattagctgggcatggtggcacgcacctatagtcccagctactcaggaggctgaggcaggagaattgcttgagccaaggagttcgaggctacagtgagctataatcatgccactgcgctccagcctgggcaacagagcaagactctgtctcttaaaaaaataatctagacaatgtgttttttattcataataaagggtctgggaagtgttgaatataataatgtgtgcggacaaatcagaacgtgacctggccccctagagtatgtgcttgataaaaggaattacttgcattatcagaatcgtttggttcttgatgaaattctttggctactttgtcatccctagcttgaggacctagaagaggtgttccatctatacataaaatctcggttacctttcagtgagatggaataagagggtcggaaggcactgctagataaaagcatgaatgtgcaaggtgcactgaaagtccttggtattgtccccaccaaacaaccaagacatcgattctgccctcctagcaagctccagatacctggaaagtttctcattgttcatgaggttgtttggtaccaagcaaaaggtttcttctgaatgaacactaggctcctctccttgtcgcaagcaaagaggctcctgctgcatggcttttgtctgaaagaggcatattgtagggagaaggctgttggtggcatgtctataccagggaggtatttggggatatcaagaaaaaaccatgatgacaacagaatgaaagttatatttgacttttccaaagggaagcccacattctagaaacagaccggcattgaatgctgccatgctgccatggtacgattttattttacttttaggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtatttagccatttcttgcctgatttcctgcatggaaattttatttttatttcataggaggtcatcacaccttgataacatgggcctttaaaagtctcttggagagaatgtgcggcatttggctttctgttcctgtattaatttgcttagaataatggcctccagctgcatccatgttgctgcgaaagacatgatctcattctttttcatggctgtgtagtattttgtgggatataatgggagctaaacattgagcctccatggacataaacatggaaacaatagactgcaaacttctagaggagagagggagacagggagaccaggggcacatggttgcaagactacctattgggtgctctgcttaccccctgagtgcaatagacccacgtaacaaactggcacatggagaccctgtatcgaaaataaaagctgaggaaaaaaaaactttaggtgacatttgtgatagacttgagtctcctcttaggtagaattaaatagttaaatttcctgcaaattttgaatgctcaaaaggcaaaaaaacaaaaaccaaaacaaaaacaaaacataaaaacatattttgctcacctccccatttttaatgttttaattttttttttttttttttactttttgggacaggatctcactctgccacccaggctagagtgcagtggtgcaatcatggctcacagcagcctcgacttcccaagctcaagtgatcctcccacctcagcctccagagtagctgagactacaggcacctacaggatgcctggctaaattttgcattttttttttagaaatggggttttgtcatattgcccaggctggtctcaagttcctgggctcaagtgattcacccactttggcctcccaaagtactggggatacactacgcctggccacttacccctttttaaaaatgaaaactagagttgccatattttaatctatattgcttcagtgtggattgttatgtaaattgattaaacctggggggtaaaattttttttctctgtctcagacacagccggaagagctctctgtccataaactattggatagtggctctgtatttacagatacctagttttaagttttctgtgttcaacacaagctatgcaggcataactataatgagctctcatcatcccataccagctcactcctacgttacaaattattactattattatttggagacagggtctcactctgtcactcaggctggagtgcagtggtgcaatcatagttcactgaaacctcaaactcctgggcaccagtgatcctctcaccttggcctcctgagtagctgggactacaggtgcacatgaccacacccagttaattttataaaattatttttccatagagacaaggtcttgctatgttgcccaggctggtctcgaactcctgggttcaagcgatcctcctgccttgacctcccaaaatgctgggattacaggtgtgagccattgtgcccagcctgggttacaaatgaggggcacattaaagttgttggtgtggattctcattgacactgtttgtcaccttccttagtggggttggcagggagtggagaggggaggatatattgttactccaccaggctgaagggtatgcagtggaatatcattcactcatatgcccctgtgcccatcagattcattatttattccaacacaaccatgagaacagtgatcagccacccactcagctctccattcatcttacctgcccttcccgtcccaacccatttgcttgggctatctttttgggaatatattcaatctccatctccttcccttctttctatgctggttgtgaaaaatgtgtaaaggagtagctttagaatgactgcatgtgacattaaaatgcaaaacacaaggtcaggtgtggtggctcatgtctgtaatcccagcactttgggaggctgaggcaggaggattgcttcagcccaggagtttgacaccagactgggcaatatagtgagctcccatctctacaaaaaatgtacaaaattagccaggcttggtggcgtgtacctgtggtctcagctccttggaaggataaggtggaagaatcacttgagcccaggaggttgagccatgattgcaccactgcactccagcctgggcaacagagtgagactttgtctcaaaataaataaatacataaaatgcagaacacaaaaagcaagatgtaaatgaggggaatttatttctctcttggggtaggcaggctacagatacagtgaggttatcttgttctctgccatcctttgtgagcagcctcatggcccaaggtagatgccaaagctccagccatcagacttatgttccaggaaccatgaaggaggtggaagaaagaaagaagggaaaatggagagtaaggagcatcaaatccttactgtggcacatctgagtctgtccttaagatatgattcttctgaactcatacctaaaagaacactttgaaacaatagatgaggagaattcatactttttaacccattcaacaaagattaaaagatttattaagctgctactttatgtcagatgctaaactggacacaagagagtataaaatgaactgcgttaaacatttttgttgttgttgttaagacagggtctcactgcgttgcccaggctggagtgcagtggtgtgataatagctcacggcagcctccacctcccaggctcaagcgaaccccttgcctcagcctcctgagtagctgggatcacaggtgtgccattaagcacagctatatttttgtattttctgtagagacgaggtcttgccatgttgcctgggctggtctcacactcctgggctcatgcaatgctcctgcctcagcctcccaaagtgcaaagaatataggcatgagccactgtgcctggctacatgaaacattttactgggaacacaaatgttctgttatccttcattcctcctcatatcctttcaacataaatcttgtggtatttacgactcacaggagtggtattgtcatctaaagtacatagaaaacctccgccagctattatgagatcttttcatcagtgcagaatcgcatttaaatgatggaaatgacttcatatttgtgaaggtaattttggtaactttctaccccttaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaagtattcagtaacagaactgtaaatatctgaagtacgggctacagaaaaacaaatctgtactaactgtctcaaattatgtccagccccttgcatagcatagatacctgaaaagtatctgtttcatcccttaattggattaaaagctggcttttaattgttcagcaataccagtgaaatatattccccaagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaa[150 bp omitted]cccgtctctactaaaaatagaaaaaatgagccgggcgcggtggcgggcgcctgtagtcccagctactccggaggctgaggcaggagaatggcgtgaacctgggaggcggagcttgcagtgagccgagattgtgccactgcactccagcctgggcgacagagccagactcagtctcaaaaaaaaaaaaaaaaaaaaaaagaatacaaggaaagtcagtgctgccaggctgccagtaaggcatttaagcagaaatggggagaaaaaaggaatgtgttaaagggaaaaacttatgggcttagttaaagggaactaaccctgacatccaaacccttttgaagcttgctgaactaaagctaagctctgtatttcttaatttaatctttgctgtgggatgtgtatgtgtgtgtatatatatacacacccagctgcagttattttatttgcacggtataaattacaaatcacttttatgcataatactatagtcagatttaatatgaattaagctatatacacacacacaccatatgttatatacatatatatatacacacaccccatatggtttatatgtatacacaagttatgttttatacatatacacacatagcactgtatgttgcatatatacacatttattatatatagtttaattccttggtaacgaaatacaaacactgaaaggtgttacagttaaaaatagctataacactgtagcctttatggaattatataattgggattttttttttttctctgcttcttttgaaatcgcttactatagttgtacttagtcaaaggacagtttcccgtaaagggattttctgttaaagtctatatctgagtgtttatcactaagaaataattatgtttgttttacagtatatgtaaatacatgatgaagacgtgttacaaaagctagcaattgcattattaaatggctaatattatttgacacaggagaaatgatgagtagctatttttctgcgtaacatctcccaaatattctgagttttctccgtcatttcttataaaaattctaccaaaataaagacatattgaaagtcagacaggtatctctgtgggtattattttactatttaacaatatgagtataaaactcaaaggtttagtaacttattaactttactcaaaaataagccataacaatgctatactcatgcaaatgcaaatacaacgtgcaaaatgaacttaatgaatcttcgggaattcagtaacattttaaactttccaatgaaagaaacttgtgcctattaaaaaacacttttagtcctttttttttttttttttaagacacagggtctcactcttttgcccagtctggctggaatgcagtggtgcgatcacagctcaccacacacttgacctcctcggctcaggtgatcctcccacctcagcctcgtgagtagctgggactaaaaatgtgcaccaccatgtctggccaatttgtgtgtgtgtgtgtgtgtgtgtgtgtgtgtctctgtgtgttttgtagtggagttttgccatcttgcccaggctggtctcgaactcttgggctcaagcaaacttcccacctcggcctcccaaagtcctgggattacatgtgtgagccaccaggcccaaccttaatcacttttcattattggtttctttccaggtgtctttggtaggaggtcttataagtgacctattaccattagtatttatatattcatatgcatctgtgtgttttcactttagacactatacagacaattatttgcaaatatatttgttctggaacagaaaaagaatttgcagctactatatttgcacagtataaattacaaatcacttttatgatttttttatactatagccagatctaatgtgaattgataatttacatataattatgctgttcccagaaagcctttacaatctttcatcttacaaaccctgggctttaaaatatcttaatttctaattatagcatttctaaaaaatagtatatgtcacttctaaaacaaatcactgagtttacgtataaacagttttctgtgcagctagttaagctagttacattttcttttatctttgaatgggacaagagcatagcacagagatgatctagtgtaaactagaaatgcagtgtgacctcaggcccaggacgatgttatctgttgattagcaaatgctcaacagacatcagaaaggaaatgaatgttgtttggaattttgctagaacagctttctacttattattttaaaaaactgtcctcctgagggattgtcaacacattaaagacagtgtctgctgagtctagcgcagcattaattgtcattagatcttaaccataacccaaacagcaagaataacctgcaatttccatgtagacttcagatagcagccaggacagcaagtctctaagggaggtggtgctgtgccctggagtacggggatggctttgctcatatgttcctggaggtgtcattttgcaaactgtatttttttaaattaatgttcatcggtttatttaactgctgggccttcttggcactgtctatttgaatcgtttggggcaatgatgaccttatgtattattacacgatttgtataataaaatagattttattatatattcaataataaaataatgaacacattatacaataaaattgtataataaaccagtactttatatattgtatatgaactattctacattttaaattaatataattaatgtatctagtatatttaatataatttatataattacattaatataataaaattaattaaagtaatatgtgacacatatcattcaattatataaaataatatagtatatatttatataaagatataaatttatgataaaatttaatatattaattagacatatattataaaatttaatatgttcattatatattatacatttattacatatactcatattttatcttatagttaatatattttcctatgtcaataaacatatatttttacatattgcattgatatacaaaatactatataataaaataatagttacatgttattatataattacataacaatttttacacaatgataaactattatataatgatatgtttctagtattgtaaagtcatatggtataataatacatagtatgtattgattgtacatattacaatatattttgttctattccataattgattatattttaatatataacaattctttatgcatttttaatacatcatgttatatattaatatgtatttgtaagaaatatgtactatatatcatacaatatataataaatatataattagtaattcaaatgtataaaagtatgtattatagtaaatatagcatatattatacattattacattatatattaaatattttaactgctggatataatatatattatatacactatattacgtacagtttaaaatagtatgtattacaatattatatgattaattatacaatatcgtgtagtgcagaataacattgaaacgctatgtgtaataaatacatagtagcagatatgtaataaagcagtggtgatctgcatcaagaggtcaacgtctttgtgtctctgaccctctccaggtaaaatcctggatgccctggaccaggagcgcctggccaaccacaccttggtgtacttcacctctgacaacgggggccacctggagcccctggacggggctgttcagctgggtggctggaacgggatctacaaaggtgattgtgtgtagagaaccaacgcctgtccattttaaatcagtagtctctattggctttgtgtttgcttgaattcatttgccatgatgttcagatattttgatgtgagttagactcttattaagctagaccgaaaaaaaaaaaaagctgcaaattttggggcagtttccaagagcttcaaagtaaaatgtttgaagcaacgccaaccccaggagacagcacagcatctcaatgaccatctgtggcagatgtcccagcctccgcacgattgacatttgaggctggaggattctctggctgggggcatcctgtgccgttgtaggtgttgaacagcgtctgtgggctccacccacacatgccagtagcacccaccgcagagcagcaacaaccagaaatgtctcctgatattgcccagtgtcccctggggacaaggtcatttctaagtgagaagtgctcctttagattaatcctcacttggattctcagatgcaggtttttaattcaatcacaccaatgatgctattcattatgctttaactagtgttatgtggatcagaaaaaagagtttttcatttgactggggtgcctagctcctcatggccagcagattcttccagctcactttgatagacttcatgccgggttgttcaagaactccatggcacccactcttaggcatcaccaaaggcatgccaacagaaagaataatttaaaaaagaattctgcattcgctattttccccctacccgctaaccttccaagtaaaacaaaaaaactaaaagggtatcaaaatcgtcatcattataaaatcagaatgtttgaacttccttatatttcattaaaaagttctgtgtgtgtgtgtcttatatatgtattttcctggaggtataatcactatgtatataaattcaccgtattaattgtatgtaatataatatagaatcatatatattcatcatatgtgatatataatcctatatatagtcactatgtatatatagttactatattcattacacataacacatataatcctatatatattcgctatattcattatatataatacatgtaattttacatatttactacatataatatacataatcctgtacacattcactatgtatatatagtcattatattcattatatatacacacataattctatatatttactatatttattgtatagatcattatatataattttatatattcagtatatataatataatatataatactatatatatttactatgtctatagtcacatattaattatatatagtatatagaattctatatattcactgtatagagtatacataaccctacacatattcactatatgtactcactatattcattatatattacacataatcctatatatatattcactatattcattgtatatatataggattgtggatactggattatatattgtaaattaatagaagtgagctcctgaaagcattcacctcctctggcttgtcatgtggacttgctgtagtcataactgttaattagcaaagactaaattggtgctaaacctagtagaaaaagtgaggaacagatctgagtcaccatatatatgccatctaacgaagtgtgattattacagtcatgatgattctaacaactgtacctattatatattataataattattataattgcatgagtatgtgtgagtgtaaagcccctgtccttaaaaagcacacataaccctggaataggactggcaaaattgttgtgagcatttctcaggctttgggacaggatgcctgtttctcagggtgcttcctgtgaagcgatgaattcaatggatagagagatttagatctcctgggtaagcaatgggttttgttctagtctagttacacctcgcagctctgccccacaaagatacaggttattaaatacgatgaagaaaacatcaggatggctttatgattgtatgttaaaagcacatagatttggttcagtgagcttgtcgagtttttcttataataaagaatggtgctacttgggaggctcaggagggaggctcgcttgagcccaggagttggaagctgcagtgagctatgattgcgccactgcactccagtctgggtgacagaaggagacagtgtcttaattaaaaaaaataaaaataaaaaaagaatggtgccaagaagctgagctgcctttcaacactggttagactggttagatcagtgaatgtgtcagcagtgaattttacctcattttctgctagaggcttccggttttgtgtttctttgtaatgctgcctgtcagacaggtgcgcacgtagaagacattcaatgaaaatttcacataggaagagaccttttcctccagagaggttcctattttttcttaaagagtctagacatatggtcttgacactggcatttggcatagggccatttttctattctgtaacaaccgcctcagtctcatgattgatcttacggcaagggcttcatttttgttttgtgctcagaaacacccaaggggacttttgtctaagaagtgattctcaactctgcctctggccatttttctactcacactcctctctttcttcctctatatgggaaatcacggggtaaagttttttagcttgttcctcaaggatcattataatgtggataaaacctgtatttttcttttctttttctttttcttttttattttttggagacagagtctcaccctgtcaccgaggctggagtgcagtggcacaatctcagctcactgcaatctccacttcctcgtctctgatcccccgacttcagcctcccgagtaggtgggactacaggcatgcaccaccatggagtgcagtggcgtgatctcggctcaccacaaccttcgcctcctgggtttaagcgattctcctgcctcagcctcccacgtagcttggattacaggcgcccaccaccatgcccagctaatggttttgtatttttagcagagacggggtttcaccatgttgg[134 bp omitted]ctttggttttaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacaggtatggaaacagtgtttgctcctaacctagggtgatatatttgaacataagtggatatacttgataattctatgtgtgtgtgtatgtacatagtatattacttaattatcaatattctgcccatagggccagatgtctttctccccttggtgcgtggtggaatattttgttttcttcttagagtataccttaatatcctttgtcatattacacttatgcctgtgtgtgtttgactgttctcatggatgggatctgattctcatacatcatcacatccctcacagcttctagaccattatgcaattaagtgttaaatgattactgaataaaaacatgtatgcctagagcaggtgcggtggctcgtgcctgtaatcctagcactttgggaggtcaaggctggcggatcacttgaagtcaggagttcgagaccagcctggccaacatggtgaaacccccatctctactaaaaatacaaaaatcagtctggtgtggtggcacgtgcctgtaatcccagctacctgggaggctgaggtgggaggatcgcttgaacccaggaggtagagattgcagtgagccgagatctcgtcactgcactccagcctgggtgacagggtgatgccctgtttcaaacaaaaacaaaaacgaaaacaaaacacgtatgtgtaattgcatgtgtgctaaatgatattattctttctggtttgcactttgtctatgagcttatttttaatttaatttaaatttattttttttgagacagagtctcgtcctgtcagccaggctggaatgcagtggtgtgatctcggctcagtgcaatctctgcgtcccgggttcaagtgattcttctgcctcagcctcctgagtagctgggactacaggcgggcgccaccatgctcagctaatttttgtatttttagtagagatggggttt[132 bp omitted]atcctgtgctttaacgatttaattccatgtatgtggggtgatatctattcattaaatgtgaagttttattggaatcaaaagggcgtaaatagcttaatttttccaatccacaacagtaactcatattgtcttgcaaggtatcaggataatagttctagctgttctcttcttccatgacctcagaaaatgaatgttttgtttctctttctttttgttataaaatgagggaaaaggagaaagttttaagaattccttcttccgccaggcgccgtggctcacgcctgtaatcctagcactttgggaggccgaggcaggcggatcatgaggtcaggagttcgagaccagcctggccaacatggtgaaaccccgtctgtactaaaaatacaaaaattagcagggcatggtggcgtgtgcctgtaatcccagctacttgggaagctgaggcaggagaattgcttgaacccgggaggcggaggttgcagtgagcagagatcgcaccattgcactccagcctgggtgacagagcaagactccatttcaaaaaaaaaaaaaaagaaaaaagaaattcttcctctttatctttcgcctccttctcttcctccccttccttttcctcctcctcctcctcctcctctttcttctgctataaaatgcgtgactgaaccatgcctctctcatcaccttctacacacccccttctctcccaagagtgattgacggccagaacctaatgcccctgctggaaggaagggcgtcccactccgaccacgagttcctcttccactactgtggggtctatctgcacacggtcaggtggcatcagaaggactgtaagtatgaaggctgtggacacgtggaaagacgataagggcccggttccggtctccttcgtctcctggcggaagctgcaccatgtgcagatattgcccagctatgatggttctttttcgctgagaaagccacataaacagtgcactgcagtaggattttattttattttattttattttgagatagggtctcactctgtcacccaggttggagtacagtggcgcaatctcggctcaccacaacctccacctcccaggttcaagtgagtctcctgcctcagcctcctgagtaactgggactacaggcacctaccaccatgactagttaatttttgtatttttagtagagatggggtttcaccatg[138 bp omitted]gtgcccaaagggttttattttaaatttttaaaatatttataaaatagagacaagatcttactatgtggcccaggctggtctcgaactgctgagctcaagtgatcctctctctttggcctcccacaggtgtgacccaccacagccgatccactcaaagcattttaacttagggaggtgagtgctgacacagacaaaccaatgccattgcaatattttcatgacttagatttcccgagagaaggggatatgccctaccacacaggttcacggtgggaagcaccagggcttggcttggaagcagaggcaggaaggaatgaggagcccaagcaacagcctttattattaggctttccaagggaaaggtcaggcagggcagggtgaacagcttcacactggtagtttgagtaattacagtaagtttggagcaacagagactgcccctagctgcctggtacccggtgctgggttgatttaggacagagaaaatatcagcttactgtgtgagagttagataaaggaggtggatgcttgcataggtagggtgtgttcctaagtgagttgttactatttgtattagtccattctcacgttgctaataaagacatactcaagactgggtaatttataaaggaaaaagtggtttaatggactcacagttccacatggctggggaggcctcacaatcatggtggaaggcacatcttacatggtggaaagcaagagagaatgagagccaagcgaaaagggaaatgccttataaaaccatcagatctcgtgagacttattccttaccatgggaacagtatggcagaaactgcccccatattcaattatctccacttggctctgcccttgacatatggggattattacaactcaaggtgagattagggtggggacagagccaaaccatatcgctatttttaggaatcagctagtcctgggaggagcagtctttccccaagtctatgaggcccctcaagctgtcaaaatactagcctggcacagtggctcacagttgtaatctcagcacttcaggaggccaaggtaggaggattatttgagcccaggagtttgatatcagcctgggcaacattgcaagaccctgtccctacaaagaaaaaaaaaagaattagccaggtatggtggcatacaactgtagtccagctactcaggaggctgagtgggaagtttgaggctgcagttggcaatgatcgtgccactgtactccagcctgggcaacaaagtgagacactgtctcaaaaaaaaaaaaaagtcaaaacattataggatacagaaaattaagacaacatgattaatgtgtgtgtgtaagtatgcattagcttgtgtgaatgtatacatgagagagagaacaagagagaaagagagactatgaatacccacagcttagggatgactgaagtaattattctagcaacgaggagtaaattcttcaacatgacctgccgggtggttgcttatctccaccttccttcctttctaacatcctagtgattgtttctgtcccacattcgtgctatggaagtcatgcaaacaaatataaattaacaaatagcatcgtttgccttagacctgtaaagaaaggtcttttggagtcattgcatgaaattccagaattcttacttggttggatttaactttatttgcaggaggaattttctctgatgggatcagtcacttgtggtgtgatgtatcttcattttgatgtggatagtcccacataaaacaattaaaaaaacaaaaataagtaaataaaaatctatgtttttaagattctatatgagtgcaggacatgatcaatgataaataaaacagccccgtaaacagcacaagcctcccaaatttaactatagaggattatacagtagaattttttgttattattttttctcatcataatttcagaagttgggagcatggggctgacacagtgctcagtgccacggtcatgggaccagggttctttttttctacttggccacctctgacatgctagctttcattcttgtgcatctcacctcatggttgcaaagtggctgcagttcctccaagcatcacacctgcactccatgcagtaaggagggaaaaaaccaaaggcggtaaagaatccagttagatgatttgatcctattttagtaggaaagcacagcttctctgcaagaccccaccagtagacttcggtataatcctcatttaccagaggctggggaatgcttatattttctatctaaaattgatctctgcagccaggcatggtggcacatgcctgtaaatccagctactcgggaggctgaggtgggagaatcacttgaacccaggaggcagaggttgcagtgagctgagatgttgccactgcactccagcctgggcgacagagtgagaccctgcctcaaaataaataaataagtaaataataaaaaatgaaaaataaaattgatctctgaaaatagatttggtaaccatttcatatcagaagaaagaagaaaggaagggagggagggaggaaggaaaggaaggaaggaaaggaaggaaggaaggaaggggaagggaagggaaggaagggaagtaaaggaaggaggaaaggagggagcgagggagggagagaaggaaggagggaaagaaagaaaagaagaaaacagaaatggaggaaaaaaggaaggaaagaagagagtgagaaagagggagggaggaagggaagaggagggagggagagacagaagagggagggagaaaaggataaagaatgattaactttgccaaattacttttgtcaatttcagatgtgaaagtggcatttagccttggatcatttttaattttgtttgtacctaatcagattgaggtagaattttaatttggtattcccagaattaccctattcccatctgggtcatcattattatctccaaatattctcatgacaagatttctaaaaatgtctgcaagtttgcagtgaaattgtgcattgttcttagagttgaagaaatgctactgttgctgtgtaatgctgtgcagaagagtattatcaatcactagaaaaagcttttgagaaaaacatctttaacgaaaagagtcctaaaatcaccacaaagatggtatcatacataatgcaacttgttttttaggtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacctggaggggagcatttgttgtataatttttttctagtatataattgtgccattgcccaaggaaaagagcaaatcaaggtgacttcagcagattcttgtagagcttttgttcctagaattcatggaagcatcaggtccaatgtcataagttagaaacttctgcttgcagattctatacccaggcatgctagctttctaataaatcatgataagtacttaattttttcatgaagcagagggtcacataaaacttgaagtagtgctgttatagtcagtttgacttcttgattttctctctttccttcttttctcttcctgtccgatacgcatctggttatgagaaaaaatgctgggctgaagttcttgactttgcttcctcgtagctatatcatcgtggaaatgtctctgtgatttggtttcttcatgtgtaaaataaggaaaaccagtgtctacttcacagagtagctatgaggattacatgcattaattaatgtgaaattgccttgtgtagaataagcagtcaataaatgttattattacaaatgttgttgtaagcatcatcaattgcagttaatcatgattccttaaacacaaaataagaaaaatggcaaagaagagtcaacatttaagaaaaaataaagaaacatggctaaaacaattatttaattgaagaaaggcatttggcaatacacataggaagtaattcaaagcaggataaacaaacataaatccaaaatttgaagcatttgtgactgcagactacaaaagacaaagaaaagatctacagatggatgcagggcaggtgagccccaaattggggcttagcctgggagggttcttggcttccctcaggaaataattcaagagtaagccagtggtggaagcaacagctttatggagaaggtagtgtcacagttctgtgaccgctcctgcagagaacaggagctcagggcactgctgcagtcatatttatacccacttttaattgcatgcagattaatgggcagtttatgcagaaatttctaggaaaagggtggtaacttctgagtgctcaggtcattgccatagaagaggccagtaatgcccagatgttgccatggcaatggtaaactgacatggcatgctgttaggcatgtcttatggaatgctgcttccatgttttagctagtcctcagtttggtcctctgtctgcttctgcttcttcttcttaccattcctgggctcaagcaatccttctgccttggcctcccaaagtgctgggattacaggtgtgagccaccacatgtggccaacaatgaatgttctttattttattatactttatattttgagatagagtctcactctgtcagccaggctggagtgcagtggaggcgatctcagctcacggaaacctctgcctcctgggttcaagtgattctcctgcctcagcctcctgagtagctgggattacaggcacacaccactacaaccagctaatttttgtatttttagtagagacaggatttaaccatgttgacgaggctggtctcgaactcctgacctcaagccatccacctgcatcagcctcccaaagtgctgggattataggcgtgagccaccgtgccagcaacaatgaatgttcttaatatcaccagcctgtgcacttaaacatgatttaaaatggtaaattttgttatgtgttattttaccataattaattttttatttttatttttttgagatggaatttccctctgtcgcccaggctggagtgcagtgggagatcttttctcaaaaacaaaacaaaaccccaaaaaaagaccgaacaaacaaatgcaataacaacatcttttgcaatttttgaagtttgaagattacttatttcactcagagctcccttgtattacttgtctttaatgctgttctcaaatttgtgtgtgtgtgtgtggaggggggggcagctagcaggtcctacatcaccccaaatccatgattttctctttattcaattctgcagtggtgcgatctcggctcactgcaacctccgcctcctgggttcaagcgattctccttcctcagcctccccagtagctgggattacaggcgcccgccaccacacccagctaattttttgtatttttaagtagagacagggtt[133 bp omitted]cattgcagccacactgcaatgtaaatgaacctttgacctaaatgaaccaattaattatgcccccacttcactaatgggccactagagggcgttagaaaaacatttctcaactactcggtcaatgcgttcaagcatgccacaggtgttcttgctagagacttgtcattgatgttttcttgagccattagaaggaaatggccatgaggaaaagactcggtttgctttatgttaatccaggggatatgatggtagataggtaccaaccagacatgtccatttcagacagtcaaagtagccaatctgtcctccacaattcagcatttttagagaaataaaaaatggtgctgaaacatgcagagtctaaaactgaatgtctgcttttcaagttctttctaattattggctagggaaaaatcagtgtcacttaacttctctgtagtgcaatgtctcaactttaaaatgactacaatagcaaatgcttcatagagttgctgcaaagattacatagataaatatgcgaaaacacaagaggctggaacgagcactttaagatgacagtaattttattttattacaagaaagactgaggttgaattttcttaacccagaacttagattaggaagaagtggtcattaaaatataccatgcattattacttattatggtcaccattctgtgcaatagatctctaagcttattgctcctgggaggggaaagatttattgacttgcctgatgtaatcattccacattgtgaacatatatcaaagcattccatggtactatatatataatatatataatattttatataaaatattatatataatatatataatattatatataaaatattatatatataatatatataatattatatataaaatattatatatataatattatataatatatattatatataatattatatattttatataaaatattatatatatattatatataaaatattatatataatatatataaaatattatatataatattatatataaaatattatataaaatatatataatatatatatattatatatattatatataatattatatataatatatataatatatatatattatatatataaaatattatatataatattatatattatatatatatattatatatataaaatattatatataatattatatataatatatatattatatatataaaatattatatataatattatatataaaatatatataatatatataatattatatataaaatatatataatatatataatattatatataaaatatatataatatatataatatattatatataatattatatataaaatattatatataatgttatatataaaatattatatataatgttatatataaaatattatatataatatatataaaatttatcaattaaaaataaaaataaaatgctgacaaaataagaggtgttaaatgaatgtataagaaacatgaggtagctgaagtaggagtcttactcaaaccatctgccctgatctgtctatcatcccatgctgggacatgaaaaggcacatattcagaggactgggggaattgagagagagtgaaggacagacagagtcttcatcagggacgctcccacatgggaagcctcctaccatgaaccttaaagacgtgagttctggaaggtgtctgagaagagattttctgtggttttgccagagagctggcaacgaggtgatgggagcaaacccttccttcattattatattttccaaaactcacagcattattttggagaattgttaaggtagtaggagggagatttaagaaatagccccagagtgtctttgtgtttgctgccctgcatgtttgccaggaagaacatattcctcaggtattagtctcgtgctgctgataaagacatacccaagactgggtaatttataaaggaaagaggtttaatggactcacagttccacatcactggggaggcctcacaatcatggcaggaggcaaaaggcacatctcacatggtggcaggcaagagagaaaaaagagccaagtgaaacctcttataaaaccatcagatctcatgaggcttactcactaccatgagaacagtggaaaccacccccatgattcaattatctttcactgggttcctcctgcaacacgtggcaattatgggagctacagttgaagatgagctttggatggggacacagtcaaaccatatcacctgaggtatggagagactgaagaaaatgaatgtgccatttttgatctttacagagggtttcaaatttgcaaatgctcaaaaatgttatccctcaaagacctttgaggaaaaagttagttgattgactccagcaaaatggaatgtaatacaagaaaggcgagagtagacaagcacagtggctcatgcctgtaaccacagcattttgggaggctgaggtgggaggatcgcttgggtccaggagttcaagaccagcctggacaacatagtgcaatctcatctttactaaaaattcgtttaaaattgctgagtgtttactaaaaatttgtttaaaattgctgagtggcacatgcctgtagtcccagctactcagaaggctgaggtgggaggatcacttgagcccaggacattgaagctgcagtgagctatgactacactactgcactccagcctgggtgacagagcaagaccctgtctcaaaatactactactactactactaataataataataaaaagaagagagtacacaggaagcagtgctgaataaataaatgtataaaacaaagtctgaatgtgttagtgcacagttgtgaaaataatctggaattaacatttcacatgggaggtaattgaaagagcagagaagaaagagagaatgagcatatgttcatgtttttgtttcgtctgggaagaagacataggtaatgactatctttatatttgatagaaaatataagcttaaatacgtgtgctgacaggtgaaaggtggttaccaccagaaaactagaaaagatgtgtacaagtttcagagccttaatgggaaatgcgtggattgaagaaaacctgattcatgcaatcagaggtgggtgggaaagaattacaccgaagaagcagaaaatctgatatgtgtaaaaaagggaaaataatataaagtgaaactgcaggactcaatccaaatataaccatgatcataataaacatggatggattaaaattcctttaaaaaagataggctttctgaatgggaaaataaacataaaatccggacatacggtagtgtaggaggcagcttaattaaaaacaaacaaaatgttgaaaataaatggatgcatttgatatgattctgttccactatccaatctaagtaatggtcaattattttatagattgttcttcagtttttttttttttttttgagacagagtcttcctttatccctcaggccggagtgcagtggtgcgatcttggctcactgcaacctctgcctcccaggttcaagcaattctcatgcctc[133 bp omitted]tcagcctcccaaagtgctggaattacaggcttgagccactgtgcccagccttcagtttggttttgtccagtgttttctcatgattagactgaggttatgcatttttggcaaaaaaatcatcagaattgatgtaagttttcagtgtgtcatgttacggagtgcatgatgtctgtatgtcctgtcctggtgatgttaaatttcatcacctggattaagtggtgtctgttggaattctccactgtgaaattattattttttctgatccaggaaaggttaagcaagagtctggcaccattttaagtctaataagaaacatttactacctgatttctctgaagcctgctacctgcgggctacatgtgcataataaaaactttggtctcctcaacgccttatcctcacccagacatttcctttctactaattacaggtctttaatcagaaaatcctggaatccacctacgacctggaagttcctcactttgaatggaatcccacctttctggactaagccaatgtacatctcacatgtgtcgattgatgtctcctgtccccgtaaattgtataaagccaagctgtcacccaaccaccttgggcacttgttctcaggacctccttggggctgtgtcgtgagccattggttaaatgaataactcttttcaaatattttacagagtttgactcttttcatggacattaattggtgccctacacgtggggcctcagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagcgacccccatttgggcaccccttttggttctctggttcctctacttgcaagtatttgtgtaagcgggaaaagcttgagggcatgccaggtcaaacaagaagcttcctgttacatattatgtctgtgcttgttcacactttaaactgctgcacacattacaccagagaaaattccagcccaaaggtcaacctgcaaccaatcagttcctaagtcctctattttgctattttcttttctgcctactttaaatcttctgtttactttttgttcttttcttttcttttctttttctttttttttttttttgagacagagtcttgctctgtcacccaggctggagtgcaatggcgctatctactgcagcctctgccttccaggttcaagcgattctcctgcctcagcctccccagtagctgggattacagacgtgcgccaccacgtctacgtaatttttgtatttttagtggagacaggctctc[137 bp omitted]gtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccat[132 bp omitted]agcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccag[142 bp omitted]tattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctg[134 bp omitted]tcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcct[140 bp omitted]tgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaat[134 bp omitted]caacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccacttgctgcttttttttggattcctgtggataaatgttgattgaaatttgttttatttcccgaaagcttataatttactaattctcttataaaaaatccgcacgatggccgctgataatgtcactgcagaattgctacttcttctgtttgtcacccagtctccaccttgcctatcgccagcaccaacactggcctttgcagtcttcctgactttctttgttttgttctttcattccatttgctgtttccttgaggtctttctcttctcacatgggctgtgtcttgcaagtctatgtttgggttcatttttctttgcataatctgaagatttgtaaatcgtgccaaaaccagttgtcttgccaccaccaaaatgaattctgaatatgaatacaaagaggacatcctggctgggcacgggggctcactcctataatcccagcactttgggaggttgggg[131 bp omitted]gaggcgggagaattgcttgaacctgggaggcagatgttgtagtgagccaagattgcgccactgcactccagcctgggcaacagagcaagtctccgtttcaaaaacaaccaaaaaaccaggacatcctgtgtggtcttgtccatttcggctagtttttcctgaatatctgtcttaggtgctgttgccttcctggggtgaaggacatcgatgaccatttgttgcctctgaagaagtcagtagctcatgaccttcctgtgtagatagttactatgtcatccatgttgacagctgagggcactggcaccatcataactcactgaagactccacagcaatcctcccagttcagcctctggagtaggtggcactgcagacacataccaccacgcccggctctttttattcttttgtagagaatgggtcttgctatgttgcccaggcccatctcaaactcctgtccccaagtgatcctcctgcctcagcctcccaaagtgctggaattataggcatgagccactgcatcaagcctaatttccattttctaaacgtgtctttccgtgccagaaaacaagcacctacagacacttgtgccatctgctcagttgctttgctctaaatataaggccctgtgtcatcaggaggcaacatacgaggcatttaaacagtgcattaagaggatcaagtctaaacgtggccactaaccaaccaaaagggtttatgtttgtcaacaacagatagaaattgaatcaagagtggtgcaataattcagcaaaacgtgtgtgaacccagaaagtctgagacaggtctcagataacttagaaagtttattttgccaaggttgaggacgcgcctgtgacacagcctccggaagtcctgacaacatgtgcccaaggtggttggggcacagcttcattttgtacactttagggagacatgagacatcaatcaacatatgtaagaagtacattggttcgctttggaaaggcgggaccacttgaagtaagggctggaagacttgaagtgggagggggctttcaggtcacagacggtgagacacaaacagttgcattttttgactttctgcttagcctttccagaagaggcgatcagatatacatctatctcagtgagcagaagggtgactttgaatagaatgggaggcaggtttgccctgagcagtttccagcttgagttttcctgagtcattttgggggcccaggatatttttttttcacacatgctagcactgagtgacatagcaattggtctcctggcagcctggaaatttcagcaacagctgataagacagcgtggtgagcagccaggttctagaaagcaaagagaagtaggcatcaacaacctgggaggagcactgctttgatccccccagaatgtgccagaccattaatgaagtatcttatttccttcttaattcagcctcatgatttaggtataaacacttgtgtgagattgcccagagctgccataaaaatcaccataaacttggtggtttaagaaaacagacattcattcttccacaattctggaggctagaagttcaaaaatcaaggtgcttcctccgaggccctgggtagaatccgtccttgccaatccttgaaattccttggcttgtggacatatcactccaatctctgcctttgtcattacatgaatgtctacgctctgtgtctttaaatctctctctccttatagagagagattatagtcatatagaatttagaacccaccttcatctactatgacctcattttctcttgatggcatctttaaagaccctatttccaaataaagtctcatgtgcaggtaccaggatttaggactttaatgtaaccttcgaggaggtcataatttaaccctttgcacccttatataccaagaagagtacctgggacttggaaatgctctgtaatttgctcaggagaacacagcttaggtgttactgggctgagactggcaccctagccatgccaatcccaaatctccatgtacatcaaccctatggtgttgaagtaggaggcgcgacttgactccagaggtgggggttggacaccagaccagattgagggctagctaaaacagggcagaccaaagcagctttcagtcagacacgcccatcagtgtgccatgtcaatttaccattgccatggcaacacccaggagttaccacctctttccatggcaatgacccaataactcaacgattactacgctttccctagaaatttctgcataacccgcaccttaatctgcatgcaattaaaaatgggtatatattttgggaggccgaggcgggcagatcatttgaggtcaggagtttgagaccagcctgaccaatatggtgaaaccctgtctttactaaaaatacaaaaaaaaattagctgggtgtggtggagcatgcttgtagtctcagctactcaggaggctgaggcaggagaattgcttgaacccgggaggcagaggttgcagtgagccaagatcgtgccactgtgctccagcctgggagacagagtgaggcacggtctccaacaaggaaaaaaatacaaataaaaataaatgggtataaatatgacttcaaaaaaaatatgccctgagctgctactctctgcctgcagggtagccctgttctgcaagagcagtcacggagctataacactgtcacttcaataaagcagttttcttctacctctggtttgcccctaaattctttcccgagctaagccaagaacacttgtgggctaagccccactttgagactcacttgtcctccaggagtgtctctcaaaggtgcaaccccaggagtaacataatcatgtgtgttcgtcaatttgcaattgcaaaaatgtggaacaagcccaaatgcccatcaatcaatgagtggatacagaaattatggtatatatatgtacaatggaatattactcagccatgaaaatgaatgaattaatggcatttgcagcaacctggatgggtttggagagtaagcgaagtcagtcagaaacagaaaaccaaacatcgtatgttctcactcataagtgggagctaagctatgaggatgcaaaggcctaagagtgacacagtggactctggggactctggaggaaagggtgggaagggggtgagggataaaagactacaaattgagtgcagtgtatactgctcagtgatgggtgcaccaaaatctcacatatcaccactgaagaacttactcatgtaaccaaacaccacccgttcccccaaaacctatggaactaaaaaaaaaattagaaaattatgtgtgtttgacttatttcaatggactgatactgttgccttgtctttactaaggagtaatatgaatgtgtcaggtgaaatacaaataactgtcttaatattaactattaaacaaggatatctttttcctaagtgatttggggcaaccatattagaccttatttgtccacaaaagaattccttacaaaggctgagcatttttctgccactctttgttctaagatctctaaaacatcttcgttttctcatcactcttaggaggaggttcgttttgaatttagaataccctagaacagaatcttaggattttagcctgagaaataacttctgaaatcgttttctcaaatgctcttatatttgcagatgaagaacacagagtgtgaagacacgaagcggctttaatgagtctgcactgtaaagggagcaggaccatgaggtctgaacccaaggttgtcaaccccaaatgcaaggtccttctccctccctggctccggtccttccattttctttaaccacatggcaaggagaaggtagtagataaaagcaagctatgtacaaccaagggaacacgttcttttccacacagtggtgttcagaggtggaaagaatgttctctagggtttgacacaattggggtgaatgggaattgttcttcttgccagctaaatatctttggacatattccctaatctatctgtacttcaattgttccctctgtgaaatgcaactaaaaagtgtattaccagacttacaaagattaatggagataatatctgtaaaagactttgcacatagcgcataggcccataggtagctcttaataagtattatatttccttttctagtggttattttgaaaataccttaagattaaaattgaaagaatgtcatctatcaaaatgatacaaacctttgccattggtctaaacactccaaactcaatgcttaattaacctatcatgacccattgcatcgagaaaattaccttcacctgccttgtctatccgaggtggtcaatattttccatatgccccttaagcccttaattaacctttttccctaaatagaaagataaattatacaattcagtctgcaaatatagttacttaagggatgtctattatttcctcattctgaattatcctttaaataatttatattctttccttcgcattgaggaatacaagcctgattgagcactgcgtgtttttaatcattacatgaatttaaacactaggtggcatgctaatatagctgcctgcacagctagctccaaattcctaatatgataaatgtgtgcatttatttcatttttgtaaagatagcatacattttaactttattctcggaagaggaatttgaaaaggaaagacacctttttcaactcatattgtttgattgcatccagaaattcacctccacctactttatccatctgaggtggtcagtattttacataagctcctcaaacccttaatagctttgaaggaatggaatgcattgcctaaagtttcagacaggaataacagaaagcaaaaattagagaaacaaagacagaagggtagcgggggagagagacagaagtatcaaggtgcatcatttatcatctggagttttctaagcacatatattttaattacaactagcatgtgtgatccgtgctactcattcatcccccagagtgtgaacataaatggagaacctagaataatccaggcactggtctaaagttggagaaaagatacgtagtttcttctgtctcaagaccgtgttcggaggatgagtaaagcaacgtgaattagagttgagatgggccaacaataaataatctcaaaaggcttggctgaaagcagcacccgcacctcagatcttggctataatttagctaaggaagcagtgtatttagaagcctacttgcaatgattttttcaaatccaaatcttttatgaaatttgacttgggtggtacagggattcaagagcaaatcccaaattggatggacccacaaatggtaaagactcctagggttagggttatagggttttccttactcagatctgcaaatggcctcagaagccctgcctctggctggagcgggtttccttagcagtgttgtaaaaaaaagcgggagatacaggaagtacacattgcatggaagcacagtttgtatgggtggataccttggggtgatgttatggggcgatgattagttgcccggccacctcttggtgagggtaattgagcaatggacattttccagctgcggatggcaggatgacagtcagattctgcagaatagaaagcttggattctggttcagaaaaatcctgcctcttcaagtatgccttgtttgattttccattgcatttagacgacatgcaagtgaaacccccacttggaaaatgccaaatatccacccacatctccagcctgtatccattctttaaacagtaaagacttccttccttctttttttttttttttttctgagacagggtcttgctctgtcacccgggctgcagtgcagtgctgcaatcatctttcactgcagcctcgacctcccaggctcaagtgtcctcctgcgtcagcctcccaagcagttgggaccacaggtacgagccaccactccctcctaatttttgtatactttgtagagatggggtctcacgatgttgcccaggctggtctcaaattcctgggctcaagccatccgccctgcttggcctcccaaagtgctggaattacaggcatgagccaccatgcccagcctatttttgtttcttctaagcagaattttgatcagcaatccagattccctaactttaaccccaagagccgaatttaggtccttgccagagaaatgctatctatggtatagacttaggaaatatgcatatttaagaggaaacttttgaagaaacccactgttgctatcagtatgagtaataatgacttaagcaacctcagttcttggcatcattcctttgtggatagaaccaggtatatagtttgcaaggccgagtgcaaaatgaaaacgctcagctcttggggaaacaggtaaaagtaaaaataaaatggttatgtctgttaaagcaaactaaatatggcctgagaagtactccgtacttctatatttgagtccttgtggatgaagggtatcctagcttaataggcaaacaaaattgaaaacctaagttaatagcatgcatctgtaacaatagctgagtgttggccaatcccagcggccatacttcaaccactcatagactgctgagtgttcaaactgcgttcaaatcaggcaaacgccgagcagtaatccatttcactgtttccgtaccgcacttccgattcctgtacctctctttacctttttctttttttttttttgagacggagtctcactctgtcgccaggctggagtgcagtggtgcgatctcggctcaccgcaagctcggcctcccgggttcgtgccattctcctgcctcagcctcccg[223 bp omitted]aggcacccctgcagtctgtctgaatctgctgtgattctggaggctgcctgattcaatcaaatcttttctttgctcaattaaactccatcaaatttcacttgtctgaagttttcttttaacagctccttgttccaaaatgtttaagaatttcgatagggtgccagcagaacagaaggaaaaacaaccacaacaataataactttttcctctgtcctcctcagttctccagctactgctctggaaattaaactgtcaaaagaacaaaagaaaagcagaatttattaagacatgcagtgcatatacacatgtggtgaaactcagtgatgaataactcaaaagcatggttagaacttggggcgcatacaacaaatcagccaagaacaatacatttgtcaagaaggaaaaaggcaaaggaaaaaggccttttaagctcctaggagctgcaaactttgagaagacaaatacaggaggaaacaaatggaagataaaggcaaattgagtaaggtttgttatgtagattcctctaggcctgtgtctctggtaattaacagtctaagtctactttcaggcaaataggagagtgcagagagtttttttttttccccactcccttagctgacttgcttttattgtttgagttaaaaaagaacgagatcatgtcctttgcaggaacacagttggagctggaggccattatccttagcaaactagcacaggaccagaaaaccaaataccgcatgttctcacttacacataggagctgaatgatgagaacacacggacacaaagaggtgaacaacacacattggggcctttcggaaggtggagcgtgggaggagggagaggatcaggaaaaataactaatgggtatgtgaacccagaaagtctgagacaggtctcagttaacttactttcttttgccaaggttgaggacgcgccgtgacacagcctcaggaagtcctgacgacatgtgcccaaggtggttggggcacagcttcgttttatacattcagggagacatgagacatcaatcaatatatgtaagaagcacattgattcggtctagaaaggctggacagcttgaagcaaaggcaggaagactggaagcagggagggggtttccagggcacagataggtgagacacaaacagttgcattgttttgagtttctgatgagcctttccaaaggaggcgatcagatacgcatctctcagtgagcagagcggagactttgactagaatgggaggcagaggccctaagcagttcccagctggacttttccctttagcttagtgacttggagacctcaagatatattatcctttcacaggttctaagcttaatgcctgggtgatgaactaatctgtataacaaacccccatgagaggtttattctgttttcttttagcagctcttgcttctcatttgtcttcagctcaaaataacccttatgccaaagggctatcttttgggttgacctatcctgctctcccacaagagccttcagcaaagtttacagttgtcttgcagaagaccacccgggtggccaaatagtgtaatagaaaggagaggtttgtttttttattatactttaagttctagggtacatgtgcacaacgtgcaggttagttacgtatgtatacatgtgccatgctggtgtgctgcacccactaactcgtcatttacattaggtatatctcctaatgctatccctccccctccccccaccccacaacagtccccagagtgtgatgttccccttcctgtgtccaagtgttctcactgttcaattcccacctatgagtgagaacatgcggtgtttggttttttgtccttgctatagtttactgagaatgatgatttccatgttcatccatgcccctacaaaggacatgaactcatcattttttatggctgcatagtattccatggtgtatatgtgccacatgttcttaatccagtctatcattgttggacatttgggttggttccaagtctttgctattgtgaatagtgccgcaataaacatacgtgtgcatgtgtctttatagcagcatgatttatagtcttttgggtatgtacccagtaatgggatggctggatcaaatggtatttccagttctagatccctgaggaattgccacactgtcttccacaatggttgaactagtttacagtcccaccaacagtgtaaaagtgctcctatttctccacatcctctccagcacctgttgtttcctgactttttaatgattgccattctaactggtgtgagatggtatcttattgtggttttgatttgcatttctctgatggccagtgatggtgagcattttttcatgtgtcttttggctgcataaatgtcttcttttgagaagtgtctgttgatatccttcacccactttttgatggggttgtttgtttttttcttataaatttgtttgagttcattgtagattctggatattagccctttgtcagatgagtaggttgcaaaaattttctcccattttgtaggtttcctgttcactctgatggtagtttcttttgctgtgcagaagctctttagtttagttagatcctgtttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcgtgaattaatttttgtataaggtgtaaggaagggatccagtttcagctttctacatatggctagccagttttcccagcaccatttattaaatagggaatcctttccccattgcttgttttttcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggctatgcgggctcttttttggttccatatgaattttaaagtagttttttccaattctgcgaagaaagtcattggtagcttgatggggatggcattgaatctataaattaccttgggcagtatggccattttcacgatattgattcttcctacccatgagcatggaaaaaggagagttttattggtgatgtcagtttgcaaactgggtagtaagtgtccctggcataaacagaaggtgctctctctctgaagagggaaaagagagattggatctcatgcctcatagggatcatattacacaatagagtcatgcatattcagcagatttgggggagaagctatgcatatttatgaggggagctgagtgcatgcccaatgggtaaacatatatgtaacatatgtcccatgttcactttggggctatgttttagcattaaaatgaggcaggtgtggtggctcatgcctgtaatcctagcactttgggaggccaaggcaggaggatcacttgagctcagcctgggcaacagggtgaaaccacgtctctacaaaaaataaaaataaaagagccaggcatggtgacacacacctgtggtcccaactatttgggaggctaagttgggagaatcggttgagcccaggagattgaggctgcagtaagccatgactgcaccactgcactccagcctgggtgacaaagtgggactgtgtatccaaaaaaaaaaaaaaaaaaaaaaaatgagatgggatttggctcttcatatgaagaggtgaactataggacacaaagacagtttgtgtgaagcctctatgagctggtgaaacttgagtaaggtctgcagttgcttatcagaaaagaatgtgtgtatagctgctcctctgtctgaatagtagtctgggttgtcaagacttagaaggggctgggcacagtggatcatgcctgcaatcccagcactttgggaagcagatgcaggcaaattgcttgtactcaggagtttgagaacagcctgggcaacatggtgaaactccatctctacaaaaaatacacacacaaaaattagctgagcatggtggcatgaacctgtggtcccagctactcaggaggctgaagtgagaggactgcttgagcccaggaggtcaaggctgcagtgagccatgatcataccactgcactccagcttgggctatacagtgagaccttgtttaaaaaaaagtgttagaagggtctgataatttgcctgggtagcttgtcttcttacggaatttagcaagagtgttgtttttcttatagccgtaggaatttaggaagttgccaccctagcctctctgtgaactcagcctgtagcaaacttttctttccttaaccttagggtctgttttagttgctaaaggggcatttattttggtctctctgatgacagggccttgtgcaacagtggaggtccttcatcttgaagttcaccctgaacatgggtaatatcacccagacaacacctggagccttcacggtaacttagggcaagtgtcactggttttccaaaacccagccgaaatttcaggtctcactagacaggcacggccctcttcttagactgttcatgtttaaggcaagagctatatttaagctgagcaccaaaagatgcgtcgaattcagtttagcctaaagctgccccctgacatattttaaggtttgcctaaaggtttctccgtacgcagtgcactgaaacctaactggatgtgtaaacaggctggaacctacttttgtgccaatcacaaagttttgtccgaaggaagtcaactgtccaaaccatgctcaaatgaggccaatggtgagctggaacgaatttggctatttctgtacctcacttctgttttctgcaccccactttcctttttctgtccacagatcttctctcaacatgagacagtgctggggtctctctgaaccgactctggttccatgggctatccaatttgtgaatcgttctctgctcagttaaactctggtaaatttattttacttatatattgttatttttctttttttttcagagacaggttctcactctgtcacccaaactggggtgcagtggcagcatcatagctcactgcagcctcccacctcagcctcccaaatagctaagagtacagatgtcccccacctgcctcagccacccgagtagctgggaccataggtgtaagcctgttttttctttttttttttttggctttagctgctagaggaatcctggtgccactggcagatctgatggaagaacctatgcattgcaaaccctgggttggagatgccactgagatacctcaggggaaatgccgaggaaggagtggaaggctggatgacaggagactgttggtctgcatgtgagacagaggtactaggggatcctggtttcagccacactgggtggttttctttaaatttacatctcatactagttcaagtcatatctggccttctggggacacagtcccaacatgtttcttttgttgttgttttttgttttactcctctgatgctacaaaggctcgaatgtatacttcttttaaggtgccctggctcatgcctgtgggccgaggtactcaggaggctgaggcaggaagatggcttgagcccgggagttcgaggctgcagtgaactatgaatgcacgactgtactccagcctgggtgacagagtgagaccctatctcaaaaaaaaaaagaaaaaaataaacaagatagtgcatttcaatgaaagaacattctcttaaaacggaatagaaaacactttcgatggatgggcagggtggctcatgcctataatcctagcactttgggaggccgaggcaggaggattgcttgagcccaagagttagaaactagcctgggcaacatggcaaaacgctgtctcgaactcctggcttcaagtgttctgcccacctcagcctcccaaagtgttgggattacctgtgtgaggtactgcgcccgtccagataccttgtctctacaaaaaacacaaaaatcagctgggcatggtggtagtgcatgctgtcccagctactcaagaggctgaggtgggagaatagcttgagcctgggagatggagattgcagtcagtcgagattgtgccacagcactccaagctgggtaacagactgagaccctgtctgaaaaaaaaaccaaacaaa[132 bp omitted]aaccccatctctactaaaaatacaaaaaattagccaggactggtggcgcatgcctgtaataccagctacttgggaggctgaggcaggagaatcgcttgaacctggaatgtggaggttgcagtgagctgagatcgcaccattgcactccagcctgggtgacagagaaaaactctgtcttgagaaaacaaacaaacaaaacaacaacaacaagccaacaaacaaaacaaacaaaaacagagtaagccaggcttggtggctcagcctgtaatcccagcatgttgggaggcaaaggtgggagaatcacttgagcccaggaatttgagatctgcctggacaccatagtgagactccatttctatttatattaaaaaataaaaattaaaaaaacagagtacctcagagtcacatgtcatcagtgtagatacaattattacccacaaggggaagaagtgtgtccccagcaaagtgagaattgatgatatctcttcagatgtttaatctcatgaatcaacatcagttttgttgattcaatggtacaaatataaagttccatgaaggaaaacagtcctaatgttagataggtcaggagggtgactatagtttacagtaatctattacatgttcaaaattgctggaagaaaagaattcaaatggttctagtacaaggaaaagacaaatgtctacggtgatgaagatcccaagtactcatttgatttttacaaattatgtgaatctattcaattattacatgtatccccaaactatgtagatccattatgcatcgattaaaaaaaaaaaagaaaactccaaaaaacccatgagctttgaagtagatttcaatatgtttcatattgaatatttacatattgaatattcacatatcggcatatttacatattgaatatttacatattggcaaatttacatattacatattcaaaaagcatgtaatgagtggagaataccccgagggaacatgctagcagtgtggttaccatatttgtctttctcttatgttttagtggagagagaaataacagtactagttcctacttcattagtaccaggaggagtgtttggcagtagaaataaaggaacgttagaggaaattccccaagtttggaaaggaaggaaggatttcccgagaaagtgatgtttgaaggaaaatctgatgggtgagtagggtaaggggtggtaatatggagcattgggtccttcctggtagagtttagcaaggaatggagtagggaaactgtaaccatgagatcaggttgaaccagttcaactcaattgtttaagctgttatacagttgaaacagaaccaacattgcatgttgtgtagcctgggcacaggcaaagggaaaaagctttgacctccaatcacactggaaactgatgatgcttccctatggaaccaaagacagctggacatgaccagaaccaggatgcagaaacccattcagaagcaaaaggtctactctcccagaagacattgtgctgaaatccaccattccataccttattataatagccaaggttaaagccctttgattaaaacttgccgcaccagcacttccacatacttctttttcttttcttttcttttctttctttttttttttttttttacacggtcttgctctttcgcccaggctggagtacagtggcgtgatcatggtgcactgcagccttgacctcctgggcttaattgatcctcccacatccacctcctgggtgggtagctgggaccacaggcatgcaccatcacacctggctagtttttgtattttttgtagaaatatggtttcgctatgttgcccagactggtcttgaactcctgtcctccagcaatcctcctgcctcggcctcccaaagtgccatcattataggcatgagccactgtgcccagccacatacttcttaacccataaacatttgagctaactccccagatcagggagacagatttgagccctgcctcctgtctccttgccagttgacctcacaataaagtcttaaaaagaaagaaaaaagaaaaaaaaaccggtaccctacagcacggcgtggtggctcacacttgtaatccaagcactttggaggctgaggcaggtggattgcttccgctcaggagttggagaccagcgtgggaaacagcaaaacccagtctctacccaaaaatacaaaaattaactaggcatggtgatgtgtgcctgtggtcgcagctactcggggggctgagatgggaggattacttgagcctgggaggcagaagctgcgctgagtcaagatcgtgccactgcactccatcccgggcaacagagtgagaccctgtcttaaacaataacaacaaaatccccaaagcaatgccctagtattggcttatatacatgtcaagcagcaagcccattgctcagtaacaaaatgggtgacgcaaccctgaagagcagtaagaactgcagtgtggctgggagacacagaatgaggtaaacgatggcaaacattgaggacggagaggtagcaggaaagaagcaacaagtacagatgattcagacctcgtggtccgagatgaggagcttcttctttatcccaggaacagtggaaaaccatgaaatgggtctacacagaacacagcgtggtcaggtctataatctcatcttctactgtgtccagagggttttggactagagaagaataaggctgggaattgaggcggtacaagttagtggggtgttgcaatcaagaaaggaagagatgatgaaatcttccacctggctcctaacattatgagagctggcacgatgtagactggtccaggagctatttagggtcaagccacaagacaggaagattaaatgattcatgattaaatgatattcgcagcctccaataaatcaacttcactattattcatccttgttttcttgttccagaccaccatctctgagaaagaagtaggattattgtcagaagtcttctttgatcttttgttctttccttttttaggggttggggagaaagtctcactgtcacccaggctggagtgtagtgacgtgatgttggctcactgcaacttccacctcccagtttcaagcaattctcctgtctcggcctcctgagtagctggtattacaggtgtgcaccaccacgcccaggtaatttttgtatttttcatagagatggagttttgccatgtaggccaggctggtctcaaacttctggcttcaagtgatccacccacctccgcctcccacaaagctgagattacaggtgtgggccatcactcctggttgctctatccttgaagggctataatggaaccaaccaaggaaagaacatagcagcaaatggccactcctcaccttggtatttctgggaattttatgaggctactgtagaaaaatggtttgatgaaatgaagcctgtgatcacctagtaaattgtagagaaatggcttccacatgtgaggttgtcctttcccgaatacatgaccttaaggtgaaatggataaaacttctggcttggaaaggtagttagtataattaggaccatatttatttttcaaatacagagttgaggacccctgtcgttttctgtaatgcaagtctaagtgggctcggagggactgtgaactctggtcctggaactgatttcataacctggggcacgttcatggaaatatacggttggaagggagcttggacaggtctctacagatcccactgctgattggttttgatagaagaaatcacttacgtgcctctgtagttgactccattttaataagacagcgcagcttcctctcttctcagctttgaacatctgtggagacagagaataaggattctcatgccatcttttaatgatgcttttataaaacttttgactagatcgcagggcttgcctctacttttctcaagatgcattaagcattctttcttcccatttgcattcaccaacccccttagcttctctgtgtcctctccaaccaaatatttttttaaaaataggcatctacacttgaccaaaagttgaatacatgtctacctgaggatactaaaagagttctatcttgattttcatacctctgacctatatgttattttgtcttgttaataatcgtaacttccaggccaggcacagtggctcatgcctgtaatcccagcactttgggaggccaaggcaggaggatcacttgaggtaaggagttcaagaccagcctggccaacatggggaaaccctgtctctactaaaaattcaaaaattagccaggcgtggtggcacacgcctgtaattccagctacttgggaggctgaggcacgagaatggcttgaaactgggaggcggaggttgcagtgagccgagattgtaccattgtactccagcttgggtgacagagtgagagtctgtctcaaaacacacaaaaaaaaccaaacaaaacaaaaaactacattgtaaagatattccatgaatggggtcatactattagtaaatgtttggatcaacatctgtagtccttttaggaagtaataagaaggtataagaggagaggaaagagatctttcattgcaatctatgtgaggctttgggtgtgagctaggtttctggggttttctcagagagaaacagcaagagagagagaggcatgcttatattccatgctgccgagagtggcaaagatatgacagcattgcttcagcagtagtggtgacattgagagggagatggtcgtaggaagtgaagaaggagaattttcccagtggagcactttttttttttttttaatagagaaggggtcttgctatgctgtccagtctggtcttgaacttccggcctcaagtgatcctcccacattggcctctcaaagtggtgggattacaggtatgagtcaccatgcctgacccacagtggagcaccttggtgcttggctataaaagttatattcccaagaagcccaaagatggagaaaaaaatgtttgttgtgtttaccaaaaacaaggtgtctgctttgtatataaccccaagagagatcacctggcggcccctcccaaatatttggagaagaatttgcagaaagttccaagtccttcaagagtaaagacacaagagtaaaagaacacaccaacattcatgatttcaaagtttgatttgctcccgaatcgaaagccagttttttcattttgattcagatctatacgttcacaaaagccatgctcattttgcaaaactcttatgctaaaaagagcgatgcttcctccttctaaacagaaacccctgtctctacaagtgtctacttttcctactttctgataaagggaagacaatctaccctgtctgtttaattttttacatgcagcctctctgacacgtggaattgggagactggagtgccaaatccgtttttttcagtgtgtaattttatagctttccccagagcaaaagaggacaagtcaggcaagctgtaaagcagaggggaggaatttcatgggacaattttattatgccatgaaatcaagacagagtttgatgccaatgaccatcttggacaggcaggatgcagagagagatgaagcccgtgacctgcagaagcgcacttcgaagaaggcatgctgcaccccagccgttctctttgccctgaatggttcctgccttatgggaccaaggaaacgggtattgctaaaaaggcaaaattggcagcttccaggaaaacttctggaggaatgtactgaggcccctaacaaattaacatacgttgggtggctaaaaataacaagactttattctcccccagttcagaacacccgagcctgagatcaaagcatctcagggccacgattctccagaggctctaggggaggctccgtcctgcctctcccggctcctgggggctccaggcatccctgggcttgtggccgcaccactccagtctctgcctccgtctccacatggcctgctcctctgtgtctgtgtctgtgttacctcttctgtctcttattttattgcatttatttatgtattttctgcatcaaatcatccattgctcttctgtctcttatagggacacctctcatttgatttagaaatcactgtgatccagtatgatttcatgtcaagatccttaactaattacatctgcaaagaccctatttccaaataaggtctcattccagattctaggctttaggatatggacagatctttctgggggccactgtttagtccactacatttgtattcacttccttccggaggctctaggggaggatgcttcctgcctcttccagcttctgggggctcctggcatccctgggtttgtggccacatcactccagtctctgttcccatctccgcatggcccttctcctctgtgtctgtctctgagaatggcaaaggtctgacagcattgcttctacagtaggggtgacattgagagggagatggtggtagcaaatgaaagaggagaattttcccagtggagcactgtttaaaacaatagagatggggtcttgctatgttgtccagtctggtcttgaacttctggcctcaagtgatcctcccacattggcatctcaaagtggtgggattacagttatgagccaccatgcctgacccccagtggagcactttgatgcttggctataaaagttatactcccaagaaaaagcccaaagatggagaaaaaaaagtgtgttgtgttcacgaagaacaaggggtctgctttgcatatgacccgaagaggacacctcttagaaagacactggtcattggatttagggcccatccagataatccaagatgatcccatcttgagatccttaacttgattccatctgcaaagaccctatttccagataaggtcctattcccaggttctgaggttaagatgtgaactcatattttaaatgtctccattcaacctactacagcttccatgggacatatttgcccagcatccagtgatgtaaactggatttctgtgtgttttaagagctgtaaaggaaggaataattatcattcctgaaatacccttggtattttagcaaaataaaagttccccagatttgcttaatgaatctttacaataagtagcagggaattaagtatcatgggtgtgatttgagacttggatgaattaagggaaaaacttaaaagttgttaaaaccttactacctcctgccagctcaccagacacctttaatgcttcaggagcagcacacgaaatataatttttgaaggaggagagttccatgtccacatctacgccaatggaaaaaatagctgggtggaaaagactaggaaaatgaacagagagtaattttcaagatttcctttcattaaaaaacaaaacttgctggttcagagataaaagaaagtgaagcacttttttttgtaaaggaaagaattataagatttgaagtgaaacattaatatgagcagtaaatgaatagctgaaaatataaggtaaccttagtggaaagggattttgaaattattctttgaaactccctctttcatatgccttgttaatccgatttatttacgtgcatttaacgtgagcacagggactcatgcttttacttatgttatgcaggatttggtgtacaaagaaatatgtctacctatactgattttggtaatttgtaaaattaaatgaagattattggttatcatgtcttcctggatttgcaaatacttggtatacacccagtttcaattgtggggaagtatattatggggaaactcatgaatcactgcttattttttcaaagcacgtggaaattccactcacatgaaaaaacatacttccacttaaaatagcataagtccaatgggtgcttttgaaacaaatgaatcaaatcagaatcaaaattctctagctctctgatcttcagttgtagagttaaaatattaagggaaattgcttaaatgttgaaaaaattttgaacagatggctaccacataaccatatggaatcaatgacactccccaaatgcatgagaaagccattttaaaaattgatgatgcaactatagttggaatacacacacgtaaacacacacaaaatgacctatggcaagttttatttataccatgcaaatgttaagttaatcatcgcctctagttaatgcatatcccagattttctgacactgtggatgaaatctagacccacttgttgtttttgcagagttacatggaaatgttgattaaatccaaatggaatcacagtttagctgaattaaatgccaaatggctccgatcacttcctggagtgagagagaggggaaatcattgcaaatgcaacctacacaatgccttctgttgaaaatttagtggatacttggtttcacatggtcacctccaagcagtagcttagaaaagtggtgaaactttacagacagacagacagggagagagagagagagagagagaggataaattagacagatagatagatgagatagatagagatgacaaataggtgagatacctaattagatagacaaatagagatagatagacaggtgatagatatagatagaggaataagtgacagactagatagataagatagataattagacaaagatagacaggtgacagatgagatggataattaatagatgagataaatataatagatgagatagatagatagatagatagatagatagataaaataggtaggtacctaggtagaaagaaaaaggaaagaaagaaagaagaaagaaagaaagaaaagaaagaaagaaagagagaaagaaagaaaagaaagaaagagagagaaaggaaagaaagaatacatggatggatagataggtggtagctaggtatgtagataaatagatgatagataaacagacagaatatatgggtgaatatttagatagatggatggaatacatagatgaaattgatggatggatggatggatggatggataggtaggtagctaagtagttaggtggctagctggatagtgatatagtttggctgtgtccccacccaaatctcatcttgaattgtaactcccacaattgccatgtgttgtgggatgaacctagtgggaggtgactgaattacgggggcaggtctttcctgccctgttctcatgatagtgaatgagtctcaccagatctgatggttttaaaaaggggagttttcctgcacaagctccttctctttgcctgctgccatccacgtaagacgtgatttgctcctcctccccttccaccgtgattgtgaggcttcctcaggcacgtggaactgtaagtccaatactctccttttcccgtataaattacccagtcttgggtatgtctttatcagcagcctgaaaacagactaatacagatagacgcatagatagatagaaacattaattcatacatacatacatagatgatagatgatagataaatagatacatagatatatagatagaaataaatagaaagaataaacggtctggacagcaggataaagaacagaatttattgaacctaaattctccatatgcgtctgaaacagtgctagccaaagcccttctcagatacaagagagggccccttgattttcattcccttgttcctcacactgatacctccttgttctcagcagcgaggtgctctgtttagcactaggagtcactgtcccagctcctaatgcaagagacatctgcaggttagcactcaaccttaaagaaagaacgtgaaagctgtcaacgctgtggaatgggatgaagcgggagagcaggtgacagccaccattacaagtccgctggctccatcagtgctctgtgtgacttcagtcctactcaaggcagccctcacctgtgggctctgcacagttctttttggcttacaagagcatgcagggatggcgagagaggattaaggcttctgcttgcctctgtccaaccttgacccaaccttgagaaaagaacagtttaatgatgtcagagacagcacaaagaacaggacttgcaagccagttagacctgcattttaatcttagctttaaagctcagtcaagatatgatcttcccaccttcctgcacctctgagatatcctgttacacgatgggcgttgttcttcgcaacatcatttgcatgtcaataagactgcagtgcacacattcaaatacaggaaggctttgtttcacacagacatcactttgagtgagccaggattgagcctctgacacagctcaatttacacaaatagcaatttactccaaaaattaactgattttttaaataaggtgttgacttactttacagttttgtttttcagatgaaaatattgagaggttttttttttctcttgtattctttacacttagagttggtttatcacacggtagacatcaagaatttgttgagtgagtcaacaaagaatctaaaattaatgatgttaatacctggtgttgtttgccatatgatataagacacggatttttttttttttttttgaggcagggtctggatctgttgcccaggctggagggcagtggtgtgatcttggatcactgcaacctccacctcccaggctcaagtgatcctcccacctcagtctcccgagtagctgggactccaggcacatgccatcaccacaacccactaatgttttttgtagtttttttgggtagagatgggtttttgccatgttgccaaggctggtcttgaacttctgggttcaagcaatctgtctgcctgagcctcctaaagtgctaagattacaggcgtgagccaccatacctcgccaagagtttttaatatacatcaaagtttccatagatcatatagttgttgtttattattattattggtagtagtagtagtagtaatttatttttcaaggtgagatcttgctttgttgcccagaatggagtgtagtgttgtgatcatgggtcactgaaatcttgacctcctggggtcaagcaatccatccacctcagtctcctgagtagctgggaatacaggtgcacgtcaccatgcccaacaaatttttctattttatgtagagatagggtctcatcatcttgccaaggctggtcttgaactatgagcctcaagcaatccttccgccttattattattattattattttgtgaaggagtcttactctgtcacccaggctggagtgcaatggcatgatctcggttcactgcaacctccgcctcctgggttcaggtgattcttgtgcctcagcttcccaagtagctgggactacaggcatgcatcaccacgcctgactaattttttttatttttagtagagacagggtttcgccatgttggccaggctggtcttgaacttctgacctcaggtgatctgcccacctcggcctcctaaagtgctgggattacaggcatgagccaccacattattatttttaatagacctttatttttagagcagttttaggtttacagcaaaatcgagtggaaagtacagagactatccacatactctgtgcccccagacacgcacagcctcctccactgtcaacatcccccactagagtggcgcatttgctgcaatccatgggcctacattgacacatcatcatgacccaaagtccatagtttaagttcctggttggtgttgcgcattctgagggttttgacaaatccataatgacatgcatcccacactatactatcacacagcatagtttcacttttcctaaaatcctctgtgctccacctatttatatccctcctcccccaacctgtatcaacaaccgatctttttattgtctccgtagttttgttttttccagaatgtcatataattgaaagcatgcagcagagagttaactttaaaaaataacattctgaattatttcttttggaaagaaaacattattttttagtcaagatgaagtttaaataactactctgtgtcagacattgtatataccttacctaatttagttgttaacatctttgtgaataaagtgttcgcatcctcattttacactacagctcagagaacccaaattcaggcagggtatgcatgtgagcttctttgcttttgagccctttgctgttgactctacatttgtttttggaaactccaggtctgccattggccatcagaataccttgatcttgactttgaccttaggcttcatttatttctatccaggtaccattaaacaggttgaagccacca[143 bp omitted]caaaaccctgtctctactaaaagtacaaaaattagctgggcgtggtggcatgcacctgtaatcccagctactcgagaggctgaagcaagagatttgcttgaaccctggaggcggaagttgcagtgagccgagattgcaccactgcactccagcctgggtgacagaatgagcccctgtctcaataaataaataaataaataaacaaaccaataaacaaataaataaaagttcttatgagtgatcatctctttgaggaataagggaaaggccattcttataaacaattcatgttttattatcactggtcttctgttttattgcatatttgatgggcaagtgaagaagaagaccaaaagaattttggagaaatgcctcgtgtagatagagttagtagttagagaaatcaaatgagagagaggaccttatttagaaatgaaagtctacctgggttacctagatatattagagaagttttggtttttcacttggtagaatactggtaaataattctttcctttccctttaacatcttaatgtgaattttattgcaattttcttattgggaaaatcaaagtaaaaccataagaggttgtgggtctcgtgaaactctacttaacataaagcagaaagtattgagatacacggagaagctctgaggggctcagtgggtctctctttccctggactgtgttacatgcatgaattcacactggaattccagatacagcatcctttttgttgaaatgcttttcaggcaggctctgtagggacctttctcagaatcaatgactggtgacacctcttcgtagcctgcacttatatttggaatccatataacctccttgcatgcaaatacacaaagatggaaatgccacatctagccgtaattaaagagagtgaaaggtggataattgctgctgtaatcaattgtgtttctatgaaaatgcttaggcataattttaccaaattaatattacagtaactatgtacttgagtcaacttctactcagttcatttgggtttaaaagaaacacagagatgagccagtttttaccgagaaaggcacacacagtaatatttttagttcttacagctggtcatgaagaaaagaggttctggattctatgatccaccttgaaaaaaaagaaattctagtttctatggggaaaatttaactgctatggagaaattctaatttcttgggggagaatgaggtgccaaagacaggaagggaggaggagttcagacagaagacattcatgcaggaagtacaacacacacacacacacacacacacatgcacacgcacatacattcacacaaacacaagaggagtagggtggacacttcaataaaagcaaggactagaatgaaaaaatgcagacctggcacggtggctcttgcctgtaatcccagcactttgggaggccaaggcgagaagattgcttgagcccaggagtttgagaccagcccgggcaacatggtgaaacaccgtctctacaaaaaatgcaaaaaaattagctgggcatggtgacacatacctgtggtcctggatagtcgtgaggctgaggtgggaggatcttctgagcttgggaagttgatgctgcagtgagccaagattgcaccactgcactccagcctggctgacagagggagactctcaacaaaacaaaaaacaaaacgaaaaaatgcagaagaaaaatatttgtataggatagcaaaaaggagcatccacttaattgaaatagccatagtatgccaaaaagtttacaggtggtgaagacagattaaaataaagcagagaaagttgttagcttgggggtggtcctcataatatgcagacaatcaaggtaagttgctgtgtgatgataatggaaatgtggatgtgaaggtcaacaaaaaacaacgacatcacctgttttgcaattgcccacttctggtgtctaatggtcaccaaatgcttccataggcaataggagatgaagggtgggtgggaaaaataaaatggcaataagaaactatccaaagacatgagggtaacctccaggcattgctgagagtgagggtagaaaacaacagtgctaaaatgcacacatgattaccattttggattctcaacaaagactggggttttcatttgtaaagactgttaactaatgtgctcttgaattccgtcatccctgctgcccagatctcctgcactgccaaaaatttagccagaaaatccgtgcgagtcatcctgctagtctccatagactagaaataaaagttaacttgttccaaaacttttctaattagattgattgaattgtactgtgcctcaaagtcatttcttttccagctcattaagctcatcctataaaaacatatgacattgttcatattcattgcaagtggattaattatccagtatgaattgtaggttccaaatgcattgaatcatatcatcatggtgggtgtagttttttaaaatcacttccaaaagagagacatttatttttgtcggtttctttgagcctctcctcatctaaatgctgtaaagacagaaaaaaatcccgacacaatttttataactagtgtaagtatgttgataaatcccacgataattccctccactgttattagttaagaattaaactttgttatgcaaatgaatcaatattgagacatacatgtcaaatagggaacaaaatgtcttaaaacttattttttctgcagagttttctttttccaaagtgtacaaaagtctatcattcttggatgttttcttaagtttattaataactttgaacaccacctttatcgatttttagaattgttaaccaggatttcttgacaaacaggttatgctgatttgaatcaggccatcaattgaaaaaaatgcctaaagttttaatatttaagtgtgctgaaataaactggtgtcaccctaagtaacagagaaagcctctgtaaaagaaaagatatttatttgggaatgtagcattgcagtggaaattcgcatgccataggaaactatgtgcatatttggtgggggaaggaagacaaagattttttgtaagagaagtattacttaattgttttgaaataattatctgtggctacaaagatcgataacaaagatgggacaggcacggtggctcacacctatagtcccagcactttgggaagccaaggcaggaggattacgtgagcccaggagttcaagatcagccagggcaatatagtgagaccctgtctctacaaaaaaaaaaaaaagaaaagaaaagaaaggaaagaaacaaagacaggaaagaaagaaacaagcaaaaaataacaaagaaaggagagacaaaaaagaaagaaagagaagaaagaagaagaaaggagaagaagaagaaggaggaggaggaggaagaagaaggaggaggaggtgggggaggaagaggaaggagggaaaaagacaaagaaaggagagaaagaaaaagaaagaaagaaaagaaaaagaaagaaaggaaaaaaatagaaggaaagaggacagacagagaaaaaaaagaaagaaaaagaaagacaagggtgaaaaaggaagtgtgtctttctcaggagagtaacaggaagtgtgtcctgcacaggacaagaatagaaattgtgtgctgcacagggtaggaacagtaagtgtgtcctgcgaagaagagacacaggaagcgtgtctcacaaagaggaggaacaggaagtgtgttctgtacagggagaaacaagaagtgtatcctgcacaagagaggaacagaaagtgtgtgctgcacaggggagaaataggaagtgtgtcctgcacaagggcgacacaggaaatgtgtccagtgcaggggagacacaggaagtgtttcctgaaaaggggaggtataggaagtgtgtcctgaacaaaggatgaacagaaggtgtgtcctgtacaggagaggaacagaaagtgtgtgcttcactgataggagtaagaagtgtgtcctgcaaaaacgaagtgcaggaggtgtgtcctgcacagggaaagaacaggaaatttgtcatgcacaggagagacacaaaaagtgcatcctacacaggggagaaacaggaagagtgagtctcatgagagtaacaggaagtgtgtcctgcacaggggagataaggaagtgtgtccttcacacgggagacacaggaagtgtgtcctgcacagaggaggaacaggaagtgtatccttcacaggggagatacaggaagtgtgtcctgcacagagtgggaccaagaagtgtgtctcaggagagtaacaggaagtgagtccttcacaggaaagacacaggaagtgtgtcttgcacaggggaggtacaggaagtgtgtctgtctcaggagagtaacaagaagtctgtcctgcagagggaaggaacagaaagtgtgtctgccttaggagagtaacaagaagtctgtcctgcagagggaaggaacagaaagtgtatgttccacaggggaggaacaggaagtgtgtcctgcaaggggagacacggaacgtgtgtcctgcacagggcaggaacgggaagtgtgtcttgcacagaggataaacaggatgtttctcctgcacatgggagtcacaagaagtgtgtcctgcacagaaaagaaacaggaagtgtatgccatacaggggagaaagaggaaatttgttttttacagaagagaaatagaaagtgtattctgcacaggggaggaacagaaaatgtgtccttcacagggggacacaggaagtgtgtcctgcacaggggaggaacagaaagtttgtcccttacaggagagaaaaaggtagtggcccatgttggtctcgaactcctgactcaagggatcctccagccttggcctcccaaaatgcaggaattacaggcataagccactgttcctgaccctcagatcatttctttatggccagtttttacttggaaaggcaggtggagggaattagagttatatttttaggttttatgcttggctttggggaaaagggggtcttgtttctaggactcgccttggggaggagggtttctaatttctaccgtgccttgggtcagagtgggactgagatactcaagatggcgagtaaagtgatgtctgatcgtcctcactgctacactcctaccagcgccatgacagtttacaaatgccatggcaacgtcaggtagttaccccatacagtggaaaaagaggagacaggaataatccaccccttgtttagcatatcatcaagaaataaccataaaaatgggcaaccagcagccctcagggctattcttgtctatggagtagccgttcttttgttcctttactttcgtaataaacttgctttcactttactctatagactcgccccgaattctttcttgcgccagatccaagaaccctctcttggggtctgtttcctggacccctttcctgtaacaatatttgttcaaaataaatctcttcaaatattttacagactttgactcttttcattgacattcctgtgagtcaggggtgagaaaaataatgacgtttttgggaagagagaaaaaacctgtacctgatggaacacaaggatttgttttctctctcatcctgggcccgttggctttttaagtatagctaccccaggtatttgtgcgtgctctctctctctctccttttctttctctctctctcatacacattccccccttttccttccccccttcctttttccctctcttttctctacctgtcttcctcccttgtctctccttactttctttcttctctctctctgcttctcttttctccctggtctctctctctctctctctctctccctctcttcttcctatcctctctcttctctctctgtctctaactttgtttctcatattctcttctctctctctccactttttctctcctttctgacttccttactctttctttcccctctgtccttctccttttcttccccatctcctcctcttcctcctttcttctccttctttcttcttctctttctcctccttttcttttcctctcttgtcttcctctctctttctctttctcttcttttccctctctcttctctctgtctctcatttttcttattctctctctgtctctctctgtcttcctctctcccgctcacctctccttttccattaaagtctgcaaagagttcccatttcttctagcaattgagatttctagacatcaccagggtggctcatatataccctaggatgtgattacctatttgggctgttgaaggagtgaaggatgtgccttcccaaaatatgctggattggtatcttgcatattttgagttgaaaacactagagaaattgtagtttcagaaagtgctagccgacctgtttcttcctgtaggcagcaagccataaagattcctttgggaggggactcctccccgtaccagggtgagaaaatagctctcatcaccagagactgggctttggaacctgcagtggacctcaacaaatgcacttcccactagtttaacccctcctatatatctccttgtgactttcccagaaattcactgcccctagccagatcccctttgtttttcatttcttctcaaatttgtcattctttgtttaaaaagcataaaagcatcttggtttggtcacctctttgaacatcacgcttaggaagatccccatggtccgtggaaaatgaacaaaatctgtatgttttcctttgttaatctgcctagcatcgacttggtttctagttgcagctacagagctcactaagagctaaaggaggttgaaggggacctctggctccccctcccccatgccatgcacacaagggagctgacccactgaccccctggacgactcatggacagctcagtgggacgggagctttggaggtcataggagtgtttatgcagaccccagagtggcttcctaggaggaacaggattcagcagatcaaagtttcccagcatctgtgatagtctgaggccagcaggagggaaggaaaacaaagactctcaaccccagccccaggtgtcatgaacattcatgggggagaaagggagcagagagtgttgagtctctgaagaggggacagtggaaaacagctctaagcagaaattgccggcttcacttcacttctgtgccttttccctctgctgtctcctgaattacatttgtttttccacaaaagaaaaagaaagaaagaaagaaagaaagagaaggattcttctgcctttggtaaccatgcatgagaatgttcacatttcttcttctcttctcctccctctccttttcctctctcctcctcctcctcctccctcttccttcttcttctttttcttcctcttcttcttcttcttcttcttcttcttcttcttcttcttcttcttcttcttcttcttcttcttctcctcctcctcctcctcctcctctccctcctcctcttcctcatccttcttcttcttaagacagggtctcactctgtcacccaggctggacaatcatagctcactgcagcttcaacctcctgggctcaagcaatcctcccacctcaacctcccaagtagctgggactacaggtatatgccactacgcccagctaatttttgtattttttttgtatagataagaccttgctatgttgtccaggctgttcttgaactcctggccttaagtgatcctcctgcctcagcctcccgaagtgctgggattacaggcatgagccaccacacctggcaaggatgtctagagttctaagagcctgtggacaagctctaagaagaaatctcttttgttctctggcacaaattgccacaggtcccttttcccacgacttatgtttctgtccttagcactaatggtttccaccttgtgaggggtgaggctgttttctcccaaccatatgggaatatgcatgttaggacttttcgtggtataagctctaatgggatttccaagtaagaaaaaatttgctagtctcaggattttagttttgttgttacaccttttcacgtttctgtggggtggtgaggtaggaggaatgtctctttttcccttttaatttttgaaactgccttttcttctttttaaggatgagtgttcacaaattgtaaaaacttccatgaagcatgaacaaggtgagtcacagcctcgtgagtctctatagttgccagcgttgactgaagtgattgtagggagagtaagagcacctgtcttcatcccttactgctccattctgaaagctccattttattttccaaaaatgtaccccataattcactgctcccttctccattggagccttgcagtatcaaaacataatttaatatttttgccactgtggtataaaaaaagaacagacaagtctgtgagtttgcaaggacactggactttttactctttccaatgcaacttgggagactgtcatctggattaggatgtgggcaaaatttggttttcatctctcgcaggggttacagaccttgggatcctggtaaacacacatagactctcacacacacacagtcacacacacacaaacatacacacacacacacacagtcacacacataccacaaacaatgtttttttctgcaagagacacttttctgttttattattctttttattgcttgttttttattttacttctattttcccaccagaaatagtggcttcaaagccataaggttaacacttgaaaaaacaaaaacaaagcatagagaacggtgcaaatttgattcatttttttttctttcaatcttccaaagtggatgtagaagggtataaaataaaagttgaggaactaaagttttcatcaaaacctgtggtgttagggtgtaggtttttattttattattttattttcctgaaaagagttaaaggaaatagtttttttctgggaagggtgaagtttctgtgagtgttttgtgggtttagagattgaataaatcaggaagacaacagatgtttggtgtgattagcaggtctgattgaatggaaccagctttgaagtctaattgaagacatttgacattaaaacgccaagattatttaggtgcttcacaaaataaaattaaaaatgagacccagtaaaggaaaaatacataatatgaaacatttgttggccaggtgagagactatgctgatgaaattattattggcatccgaagactccactttgattgaaatttatttaaattttccattctactcagtggtgttctgctgaaaacagtaaaaatttgtggaatatgaaaaataagcttaagtacctttttcaaaatcagtagatgtgactagaagaatttaaaacaagatacacaattaacaactatttggagaagaaagatgaagagggaggtgaatgggaaatgaatttcttatatttcagatttggaagtcaaaacatcctgcttaaaagagattggcatataaatacagctatcttgcataaaatttcagagactatcattcaagaatttaaaactgcctgggtacggtggctcatgcctgtaatcccagcactttgggaggctgaggtgggcagatcacctgaggtcaggagttcgagaccagcctggccaacatggtgaaaccccgtctctattaaaaatacaaaaaaattagctgggcgtgttggtgggtgcctgtaatcccaactactcaggaggctgaggcaggagaatcacttgaacccgggagacggaggttgcggtgagccaaggttgcgccattgcactccagcctgggtaacaagagtgaaactccatctcaaaaacaaaacaaaacaaaattaaaaactgaaaaggcaaaagggatttctatgacctcccatttgaccatatctagaaggggagagggaaatactttccacatatttttacctttgtgaactattgtgtttttatggctgtcttgcaggtatcaatgtttcaccttggaacagggaaccaaaatagtacataaagctctattatcacatgatccagcaacctcactactgggtgattgcccaaaggaaaagaaatcattatatcaaaaagatccctgcacacgtgtttatcacagcaccattcacaagagcaaagatatgaaatcaacctcagtgtccatcagtggatgattggataaatcgaatgtggtatatatacacaatggaacactacacagccatacaaaataaaatcatgtattttgcagcaacatggctagaacgggaggccattatcttaagtgaaataactcagaaacagaaagtcaaatactgcatgctttcactaataagtgggagataaataatgtgtccacatggacatccagcgtggaataatagacattggagactcagaagggcaggaggctgagggggtgagggatgagaaattatttaatgggtacaatgtacactattcaggtgatagatacattaaaagcccaaactttaccactatgcaatatatccatgtaactgcacttgtatcccttaaatttatacaaataaaaaaaataagcttctacatatactttgcaccaacccattgtattttacttcccatcagtagaaatacaattctctcttttacttgaggtaaaaaaaaaaaaaaaaaattcgttgttgttattgtttgttttgttttgtttctacgatgagaaataccagttcatggcattgctgaggggaggctacatgaacagtaagcagtcaaagctgcaacaaatagaataattaataagacttggtctacccaaagagacagcaggacccatgatggagaaggtgcgtgtgaatgaaatcaccccagcaaggcgtgtgcattggtttcctggagggctgccatcacaaattactacacactgcatggcttaaactaatggagatttattctctcagccttctggaggccagaagcatctgaaatcaagggatcagcaggatgggttccttctggatgctctaggaaacactctgtttatgacacttctgcttctggtggttgccagccattcttgacattctttgacttgtagatgcatcactccaatctccatctccatcttcacatggtctttttctttatatctctctgtgtcctctcctcttctgtttatttattttttcgagacccggttatgagactggctaatttttgtattctgtattttttgtacaaaagatgtttcaccatgttgcccagactggtttcaaactcctgggctcaagctatccagctgcctcagcctcccaaagtgcttggattacaggcatgagccaccacacccagtcctcctctcctcttcttataagggtgtcagtcattaaatttagggcctacttaacctgcaaagattctacttcccgataacgacacattgtgaagttccagatggccatgaattatgaattatcagtggagaatactacttagctcactacaacctgcaaaagtgcaagaacacaccttctgtaatcttctgtgaccagaggagggaaagagactcaaaaagattggaagggctgaggctgagaaatggagtgaatttcctatgggtgacttttccatttccaggaagtatgtggtaagattatgaaggggatcagaatatgccaccccaaaatatgacactttggtgcaagcattattttgagctaaaggctactgagtaaaagtagacacaggacaagctttctaccctcccactttctgcttaaaagcagggcatatgttttccatttgaaaagaaaattcatttgtaaagaaaaatttcatttataaaggtgttctctcatggatgattccagagatagagattatcacctgagatgacttgagtctatataataatctatacttaccaggcattttctagtcaccttctacaaacttacccctatcctagaagcttaaattccatttgcctttgtctagttctttatctaaactttgtcgccctgtgttaagatggtatataatcccctaggcccaagcacctctttggggttctcacttcttttccatgtgtctctccacgtgcacacaaaataaaccatttcttctgtaaacttgtcttttgtcagtttaatttgctgttctcagtaactaaatcaaaaaacgaaggttttatttttcccccttttacagttacctattaagagtgtgtttgtgtgttggggagatgggaggttggtgggattggcagtggaagggtctaatgttagaagacagcagagagttaaacattgattttgtcaatggcaaagagcaggatgacaaggcagtttggagacctggttggaattagggacctaactgtgctgtggcaccagcattgttagtggagaccagccccctggataggaaggggatctctggcatttgggctcactcctttgagtgagctaccatcattatggtagttttctaggtaaatgtttgcatagacaatggggcaaataattaaacattgtggagaattcctcaggtgttggaccatggaatttaagttgggtgggtagcaaaatggaggaagcagcactagtgaagaaggattaggcaaaagagtcaatgaattcgagagtctacctttgcaaatatggttgtgtttttctctctcctttcaaaggattatcaacatcctcatttagcggtattggtatgagcaacaatatttcctagcacaatctgtgaagtattcagtctgaggatgacttcagcaagtcaagaaaccttagaagaacaaacattttctttttttgagacagggtctcactgtgtcattcaggctggaatgcaatggtgtgatcctggctcactgaagcctcaacctcctgggctcaagcaatgctcctacctcagcgtcccgagtagctgggaccacaagcgtgtgtcaccatacctcgctaacgtttgaatttttgtagagacagggtttcactatgttggccaggctagtctcaaactcctgggctcaagcaatcctcccacctaggcctctcaaagtgctgggattacaagtatgagccaccatgcctcgccaaaatttgtctttaaaaccatctttaaccatatgacccgatcactccatttcctaggtatatattaaggagaactgaaaacaagtactgaagcaaaaacttggtatgcacatattgaatgcagttctgtgcccaagacacggaaggtggaaaccaccccaaattccatcagtggttccatgaataaacagaacgtgggccatccagacagcagagtaccattcaggggctgggggaggaaagaatggaaatgtctccttaatgggtacgggatttcttttgtggtgatggaaatgttctggaactaggtagaggtaatggttgcatatcattgtgaatgtgcgaaatgtcactgaattgttctccttaacatggttagtttttcttatgtgaatttcacgtctataagaaaaatgaaaaaataattcctctctgctctttcttgttatgagtatatacccaaaggaatagaaatcattctattataaagacacatgctctcttatgttcattgcagcactattcacaataacaaagacataaaatcaacctaaatgcccatcaatgacagattggataaagaaaatgtggtccatatacaccatggaatactgttcagtcattaaaaggaacgcgatgatgtcctttgcagggacatggatgtagctagagtccattagccttagcaaactaacacaggaacagaaaaccaaatactgcatgttctcacctataagtgggaggtaaatgatgagaacacattgacacatggaagggggaatacatactagggcctgtcagagggtgggggatgggaggagggagagcatcaggaagaatagctaatagatgctgggcctaatacctgggtgatgggatgatctgtgcagcaaaccagcatggcacacgtttactcatgtaacaaacctgcacatcctgcacaggaatccctgaacttaaaatgaaagttgggaattaaaacaatataaagaaatattccatattcttaaaaaaggaaaaataaaagaaaacattttgatacatattaaatggtccataggatcacaaatatgctatctattacatgatttccctactagtgtttctgcggaaaaacaacttctgaatgaaacaaccggaaaagcacaatcttcaggcaagacacgtttgacaggggctttttctgtcactttgttcagaaaatagttttgtccttgaatattatagggaggacagttgaaacataaaatgaatggttgttaaagtgcagcataataaaatctttcattttatacattgctgtctaaactcttgaatcaatactttacattggaaggttctaccttagagaattaatttattctaactgtactgtaaaataaaaagactggggacccaactaagaaaaacaaaattaaccagccaatttatactgtcctgaaagtgaaggcaaccaagtatttctgccttatccctggaggttttatccaaagggaatgtattagtccattctcacactgttataaagaaatatctgagactgggtaacttattaaaaaaagaggtttaattggctcatggtcctgcagggtgtacaggatgcatggcagcttttgcttctggggaggcctcagaaaacttacaatcatggcagaaggggaagctggtgtcttacatggctggagcaagagggagagagaggcagggagatgctacacacttttaaacaatcagatttcatgagcactctatcatgagaacagcactagaaggatggtgctaaaccattagaaaccgtccccatgattcaatcacctcccaccaggcctcacttcccaaattgggggttacgattcaacatgagatttgggtggggacacagattcaaaccatataattccacctctggcctctccaaatatcatggtcttctcatactgcaaaatacaatcacgtattctcaatagtccccccaaagtcttaattcatgccagcattaactcaaaagtccagtccattgtctcatatgaaagaaggcaagttccttctgcctatgggtttgtaaaatcaaaaacaagttagttacttccaagatacaatgggagtataggcattgggtaaatactcccatttcaagagggagaaatctgccaacagaaaggagctacaggtcccatgcaagtctgaaactcagcagggcagtcatcaaatcttaaagctccaaaataatctcttttgactccgtgtctcccatccagggcaccccagtgcaaggggtgggctcccaaggccttgggcaggggaggtctcagagaaaaaatcatgctgcagttaccctctgtgtgaatcaaagaaatttattttgcttttttttttttctaattttctcattatagaccttattttaaagctgtgagttgaacactggttcactgtgtgggaaaaaactgaagaaccctatcaatttacacactttatagggactgcttatggagccccttgctattctaaccacccggaaggtaggatctcagtggatgaaacacttggaaaaacaaatcattattctttcctattcatgcttatgttttgtttgaataatgattttgttttacttacaggttttttttttttaacttggctttacctacggagtcatttataatgtgtcagacatcctcgttcaatgggaagtctgctgtataggactcaatagtagttgctcaagaaggggaagttaatagtgtgtcagaagtcagtgagaagccagacatcttcctcccccatggagaggcacaattatatgcaattacatcttccttttcatgcctagggaagtcactgatatatccactcataaaataccagactttgggtgtctatttagaagtttttacagctcaaaaacaaattttaaagacagtctcaaactcaatgtcttaggaaggtcaaccttaaaatgaatagaagaccttaagttgtaaaatgtagggctcatttaatttatagccatggatctgtgtatttcagacacacatggggaggagggaaagtacaatgtcatgcagggctaagaatcacctagtccaagaatcccgcaaaacctctcaaccttgttttcccaatggccaatgttgctgtgaacatgaaaattgaggcagtttcaggcactcactatagtataaattgggttctcttgcaggcaacactgaggccagcattctgaatgtgcaactttggactaagcacattgcacatttaggaatgtaatctaagcaaatactttcagttgtggatgcaattatatttattgtaatgttgataacgttatagtaaagaaaaacaatgtgaatatatgtcagtgagagattggacaaatcaccttgaataaatatatgcaacagcatattatatagctgtgaaaatggacaaggtatttatttacattgtcaaatgaaaagatgatagagaattgagtagcaaagtagttccaaatagtatctgtaatataatgtcttttatgttaaaattacatgttaatagatgcactaaacattttcccagtgaaatggtatatgttgctataactgaagttacaagaatgtaaagacatggaaaggcttacatttgttcttaccctttcatgcagtctgtatttttatctatctatctatctatatctatctatatctatctatctatctatctatctatctatctatctatctatctatcatctatcatctatctatctatctgtatctatctatctatctatctatctatctatctatctatctatctatctatctatctatgtagagaccgagtcttgctatattgcccaagctggattcaaacacctgggctcaagcaatcctccagcctcagcttctggagtagctgtaattacagaggtgcaccactgcacgtagctattttttaaataataaacatttttaacacatttatctaaaacatagtgagaaaagaaaacagagaaacataatatttggaatactggggaatagcgtctgtcacttctgtcctgtctgttgctattttataaaaagccttaagaaccagcagtttacacgtagttttcaggcaatcagacatatatctgctatgagaccattttttaaatgatgaaataactgtgtgcgtgtttgtatgctttgtatatcagtttacagcagatagctattcaattcttctttgagatgtaaaaggaaaaaaaaacttccccaaggtgttgtgttacagactgaatgtctgtgtcttcacaaaatgcatgtgttgaaatcctcccttcaaagtgatggtgttatgaactggggcctttgggaggtgatgaggtcatgaggatggagcctaatgaatgggaagattgcccttataaaagagaccccagagggttccctcaccctttccaccatgggaggacacagtgagaaggcgccgtctatgaactaggaaatgagtccttaccagacatagaatctgccatgccttgatcatgcgtctccagcctccagagctgtgcatgatcagtgtgttatttataagccatccagtcttaggtattttgttatagcagactcaatggacaagaaaaaaaaactttggcttcaagcaaagtgagcttgctcctctgtccttaatagacacaaacaaatggacaaagatgactgcatcatcccaacccataaatcaaagattttcaacccagaagcaaagatccaactgacataagcaaagctcctgtctgtacagggataaacagaaagtgtgcagatcacaggtagcctctcctatttgtgcaaacccctttgtgaaactccacagattcatggcagaatcatcactttggtaaccaaaaggaaccttgcaatttgtacagtaattcatctataggtgcattctgacaaaccaagatattcttggcattgcgcttgtcattgtccatccagtgaagagcaggatggattcatcaactttcatgagctacatactagaagaaagcgctgagaagttagtgggcattggctacccctggtacaggttgcatggggatagatgacatagatgtaatcttaaggtgggaatggagtgatcagaggaggcttcctgatgcctgtgcaccttctgagcccttgccgatgaatgacaagtggaaaggctaccttgagcaaaagaagaagggagtaggggttcctagcaggaaggtggggttcctgcttggggtttctagcagaaagatgccccagtgccttggcttataggcaaaaaatagcagatattggggaactaaaattggttagcattggctggtgtgcagcaggtactgaagaggcaggtaacagtggtcaggtaatgatgaatttacagatgaaggtgtggaaataaatgaaggccacccacatgaaaacaagcaaggtgtttattcagagcttgctgtagcaaaggaatcagccatcatcactcacgtctggccgagattcaaaggccggcagagccatggggaatccttatagtggggaaaaagggaaaacttaggtgtgttctgattggaggcagttggtggttcactagaagtgaggcatcctttgtgactggttagggggaaaatttgggtttctctgtttggtcctgagttggaagtaggggaaaaattagggaagctcatagttattgatcaagttctggacattttgggctggttgctacagggcttcctattggcttcctggatgagttactacagtttataggttagacctctctctttatatatagtctagtcaccgtccatttgtatattacttctctcaatgataaggatttgagaacatatgctaggaacaatagttatttaagtgttttgacctcagggaatttttattctattacttgtttcgtcattctttctcctgcatcttttcatttttttgcacactgtgatgtgtgagtatcgcattgctgctctcccaaatatgtcattcaagttttttgccttttcctccatggtttttatttctgtattgttactctgagtttcagatatttcttccatttactcttctagttcagggattggcaaatgctttcagcaaagggtcaaatagtaaatgtttttggcctggggagccattcagtctctgttgcaactacacaactgtatcattatactgcaaaagcagtcatgcacaatatataaatgtataggtgtggctgtgtttaaataaaactttatttacacaaacaggctgtgggccagatttggcttttgggacaaaattttatgacttcttttctaggttacttagttaagtctcaacagatgtgtccctgaatcagtgaatacaatgacaaatacaaatgcataatttgttaaataaaattgtataaagtatatgtgtgtgttatatctccctaaatactctgaaaggcatcagactatgtcatctccaaatatgccactttggtgtgagaattatttttagctgaggtggaaggatggcttgaacccagaagttcaagtttgcagtgagctgagatcacatcacctcaatctagcctggatgacagagtgagattctgactcaaaaaaaaaaaaaaaaaaaaagaaaagaagaaagaaagaaagaaagaaagaataaagcaaaataatagaggtgcagaggagatgcaaattccacatatggtcagataaacttgttgaatgagaaacacaattttccaacttagaaaataatgaaatcgaaagttgaagagggtgtattcaccgagaggaagtgggagagtcaatgactggcatttccatgagttcagatggcaggtcctgtggggatcactgagagctggaattgcaggaagagccacttgtgttgtgcgtcttgagtgatgacaggcaaatagtggttctggaagtgccttatggaatcaggatggctggggaggttaatcatggaactgggaggccagtgtgtccaacacgttatgcatgcagaaggggagactctgatggggttcagcacacactaccccaaaatacagcattttggcatttgaaaaaaagaaaacaacaacaacagcagaaggagaaaacctactctcacctatccctcagccctttccctcagccctttcccctgaaacatgttgcccaggctggtctcgaaccccaccttcctgctaggaacctctactcccttcttcttttgctcactgtagcctttccacctgccactcatcagcaagagttcagcagatgcacaggcatcaggaagcctcctctgatcactctgctccctgaagcaagtcaagaaaccggggaagagttctctaacctttccctgaagcaggtcctaggaccttgattcaagaagtgccctgtctatctccagagagaaagaacatctttatttctgaagacacagacacagagaagaatcctaacatgcagcccttgctaggttccccccaccccagtttattcccgttagatcacgccctgttgtccctcaatcacacttctgtgtgatcgcccacaaaaatatagttttctggctggtcatggtggctcacgcctctaatcccaacactttgggaggctgaggcagggtggattgcctgagttcaggagttcgagaccagcctggacagcatggtgaaaccctgtctctacaaaatatttatatataaattagccgggtgaggtggtgcatgcctgtagtctccactactcgagaggctgaggtgggaggatgatttgatccctggaggcagatgttgcagtaagccaagattgcaccactgcactccagcctgggagacagagccagacactatctctctatatatagttttccctgggtctttaggtttttatcctaaaagctcctgtatcacatacaatttatactacgtaaatatgtatgctttcttgtatctggctaatctgtcttttcttatcagggtctcagccattaaccttgcgatgggtgaggaaaagatcttactttttctctcctacaatgtgtaggagttagggagtttataaaccgtgcaacaagactacggaggagacctgaggaatggaacgccctctgaagagttgcctcagaggcagagacaacacagagcagaacggacttggggattgtgggtgggactaggggcatagactatcagaggcaagtgatgaggttactgggtgtgtggcttatctagagaactgctcccagagagtatgcgtttttggggaagcacagggctaaccaagatttgcactctttgtacctcagaaggctttctgggctctggaaatggagcgaatcagctgaatctgtgatggccattctggctccagaaagagactgcatgtccaagttccctagtaagctcctggggaattaccaggatctggctagagacagaagctgcccctcttggtgaccttgagactcgttgcctcctagtattttgcaggacagaaatgtgagctgcctttgtgtcttgctgtgtagggttattttctgcaaattggctgagattggcgtggcacctcccaaaacttcattttgaggactctccccaaagactggaattcccttagcaaagatcattttttaatgcaaaccatctgcttcaatgaaaaagaaaaagaacaagaaaaagaaagaagtaaaaagaaatcatgacctcagttttctgcaaaacagacgaatccttggttttcaccaaaaggcaaaacgctaattaatttttaaaatgctgacctcctttgaattattttagtcctttagatgaaaaacatgtgtcatgattgcatgtgtttttattcttccacaggcttggaactctgggtgtttggggaggctttctatatgcctcaaagcccttaatacctcattgtgaactggcatctcaggttacttctctcatgagtgacagaacaaagacctgcattgtgagcaggggagaggcaagggtgaattttaaagcataaagtggttgaatttagaggcagaagaagttggagagggggagagaaatttacttagtttataaatttgtctggagctggccaacgtatgccaattatatgaccagttcaggtagaagtcagacctagaaaaagaagaaaaacaatatacaaatgaacacatgtgaggtgatattagagcattggcaatggggatttaggggctatggttgattttaagagtgtgtgtgtgtaattggtgatcaagaattattggtactcaaaaataatattaattcacaatatagttcgatttgaataaagagtggcttgtgatagggaggatatataacttacttctccttaagcttggcagttatattgttttctgggggaaaaaaccagtagaggtattttagaatagggtagaaaataaaagtagagtcctgaaagtagatctatgccctcaccacacacaagcatactcctttgtaacacatctccacagtaactatatcttcttcacaaggaattaaatgagaagaaaaccatagactactatgcacacacaagctattaatatcttctttctgcaatttttacagattttctcaacaccattgatttataggatcgtgagcaagaagcactgatggccatgaagatgaataagcaaggaaaagtggtcttagttagtgaaattgatgatgatttcatgtcttctttatcataggggatgcctaagttctacaattcatattatcagatctgatgaattagaaactcatccacttcttgcttgcactagaaaaaatgccagacactgtgaggccaagcaaatcatgactaactaaaatttttgaagaacaggaactccaacacataatgagatcatgtttggttttcccagaattgttttttgactaaatggaaagcaaaaagaaaaaggaatttgttaaagaagctacaatgtctacatcaaagccaaaaatacttggagctctaaaaatacacttaacattttaacccagggggaaacgtttgtctttcaaaagtgaattagggctgggtgctgtgtctgacacctgtaaccccagcactttgggaggcgaaaggctcacttgaacccaggagctcgagagggcaacatggcaaaaccccatctctacaaaaaaaaaaaaaaaaaaaaatagctgaccatgaaggtatgtgcctgtaatctcagctacttgggaggctgagatgtgagatttcacttgagccctggaggtcgaggctgaagtgagccatggtcataccactgtactccagcctggtcaacagagtaaggctctgtctgaaaaaaaaaaagtgaattaggaagatcaatgatttaagaaaataaaatttgactgagatttggggaatgtgcattattcagaaaaaaattgcaaaatgttattccgttgtaaagatatgctggtgttatttaaatattaacattctcaaaggtgctatatcttagaaaaagaacaggaagagtgctttcagggctgaataatggctttggcaatttgaactgatcaaattgaccagatagttaccaaacttcacctgattttgcacgtatatgtgatgaccatgtccaggaaaactggaatgatggaactatctatcatatatatggtagactctatgtccacctgggccactggccccaggacatatactatcatacatacagtaggctgcacttccacttggaggcctggaaaggggacaggtattattatacatatggtagatttcatgtccacctggaagagtgtagccagga[217 bp omitted]aggcaggagaattgtttgaaccagagaggtggaggttgcagtgaaaaaaaaaaaaattcactttcacccgaaggactggagccagggcatatactagcatatacacagtaggcctcattttcacccgaagtattggacccagtacgtatactgctatatatatggtaaattccaattccaactggaggatggcagggggcttatattatcatctatgtggtagatttctttttttttaatatatattttatatatatatatttttgagacggagtctcgctctgtagaccaggctagagtgcagtggcatgatctcggctcactgcaagctctgcttcctgcgttcacgccattctcctgcctcagcctcctgagtagctgggactacaggcgccccccacaaggcctggctaaatgtttgtatttttagtagagatggggtttcaccgtgttagccaggatggtttccatctcctgaccttgtgatccactcgcctccgcctcccaaagtgctgggattacaggtgtgagccactgcgcctggccatagtatatattatctgtgtatgttaaacttcccttccacctggagaactgaagccagggtatatattatcatatatatggtagactcctcttccaccaggaggacccagtgtgatgggtaatactgaatgtcaacttgattggattgaaggatacaaagtattgatcctgggtgtgtctgtgaggatgttaccaaagaagattaacatttgagtcagtgggctgggaaaagcaggcctccccttaatctgggtgggcacaatctaatcagctgccagcttggctagaatataagcagggagaaaaatgtgaaaagagagactggcctagcctcccagcctacatctttctcctgtgctgggtgcttcctgcttttgaacattggactccaagttcttcagttttgggactgggactggctctccttgctcctcagcctgcagacggcctatcgtgggactttgtgatcgtgtgagttaatacttaataaacttccatatatatatatattccattagttctgtccctctagagaaccctaatatacccagggcatatattgtcatatatatggtagactccccttccacctggaggactagagccgggacatatattattatatacatgatagactccccttcctcctgcagccaggacatatattatcttacatacagctgtagactcatgtccacagtgacatcattaaatccacccagtgaggttttctactgtagtgttgactgcatggggatttggtcagcaagtccccataacctccaaatctactggatgtcctcccatgctaaagctcactgacttggaaaactctcaagttgtgaaatagattcatataaaaatggaccctccgctccacatctggaattccataattctgaatgtgtcctccttttcaggcacttccttggaccatgttttgaatgccttgcctgcacagcttacctcttccttggacactgccagtgctaccatatttgagatgatgggtcggtcgtttttgttttgcagtggtagtcagggttctccagagaaacagaaacaataggatatagaagtacgtagagatttgttttatggaattggcacacgattgtgggagctggaaagtctaaaatcttcaagacatggtggtaggctggagattcaggtaagattgatgttgcaacctcgactcctaattctgtagggcattgggccagaaactcaggcgtaatttctataccttagtcttgaggcagaatttgttcttctttggaaaaacccagtctttattttgttgttgttgagacagagtctcactctgttgcccaggctggagtgcagtggtgcgatatcagctcactgcaacctctgcttcccgggttcaagcagttctcatgcctcagcctccccggtacctgggattaaaggcaagggccatcaagcctggctaatttttgtattttaagtagagatggggttttgccatgttgcccaggttggaccccagtctttattcttaaggcttttaaccggttggatgaggctctacatgatagagggtcatgtcctttatttcaagtcaactgattgtagacgttaatcacatctacaaaataacttcacagcaacaccaagactggtttgagtaaacaattggataccatagcccactgaaggtgacatataaaattaaccaatacatcccaagggcactcaataggtccagtccttctggtggaagaagagtctaccatatataagataatatatgccctggctccagtcctccaggtggaaggggagtctaccatatatatgataaaatatgccctgggtctattcttccacgtggaagaggagtctaccatatatcaggtaaaatatgcctgggtctattcctccaggtgaaaggggagtctaccatatatatgataacatatatgccctgggtctatcatctatgtatcttatctatcatctatctatgtacctctctatcaatcatctatctatgtatctatctactaaacaaaaaaatcagggctaagcatggagactcatacctgtaatcccaggacttttggaagccaaggcggggggattgcttgagcccaagtgttcaagatcggcgtgggcaagatggtgagaccctgtctctatttaaaaaataaaaaaaaaccttaaaaaaaggaaaaatcaggcttttaaataattagttttattcagtatcttactgaagattgcaatcccggaatctttcagagtttctgttagactgctccaaaacagtgtttcaacccacagcttatacacaggtggtagaagttctgcaggtgctcagaagttacaacaaatgtgctcagaagtcatagaagtcacaacacatgttctcagaagtcacctcagatgtgctcaggtgttgcattagagccagttctcatcaaggtttgagcgccagggaacaactgtgtatagattacagaggcacagtcattaatcctgtcggacattatgtgtgggaaggggcagggactaggagcactgaaaccatcttttctaaaaatgcagcgattcaggcaagagatgtgggaacctgtgctcgatttatcccatttatcgccctcagggcattcttccacagggctgggctatgtcactcagtcagggattttgtgacattcccctggcaaacagaaggcactaacatagcttgttacacttgcgactttgtatcacatatctctctatctggtcctagttcctattggtagtttctctggagaactctggctaacacaggaagcacttcctcctgagaatagcatccaatgataacattttgcaacttatgtatcttacaactggaggaagaagtggctgtgtaaaggagaaacagggatagaatgcccttcaatttttggcttcctgatccctggaaagattggacaggtgagagcaagcatacacaaggaaggatttggatggagacagagaagctttgtctggtgaacatcattttgataaagtaattactatcaatcatgaaagtttaccagccgttaatcaggacgccatcccttttacaaaaaatactgctacaaatatgacccgatgctcgttaaggtcttcattattcttggtgattactagtatcctcatttgcaaatttattttgccagtaaaaaggtgaaggcttacagaggggaacaagtggccccagcgtggccaaatgttttgtctgcaagctggaaatggattacattttcatgtggcctcctgattagtcacagtctcttagaagaaagagggttctgtttatacatcgaaactctctgttttcttttttaatgaatagtttcctttttgttatacagacccagaaagaaaggtgactggactggatgtcaaattttagtcggtctgcttttatgaataaggaatattcataaggcaaagaggagacacatcacatcactttgtagggagcaaaaagttgtttgcaagcgtctctctgagtcaacaagcttcagttagaaagcagtgttcctaactgaagtagattatcacctaaggatgaaaatgaagccacataaaagtattgaatccttgggttgggttacttcagacttctggtcttttttttgtgtgctgacctcccgtggacttttcaggcagcccccacggtgagcaggaagagaaccatggggcttaatcatgcacgaaatcctccatcagtgcaagggctggggaaggagggctattatttgcacatggggaggcatgagcatcattaaactgtttcgctgcagagaatctacatgtaccagagatgaagagtgagagtaactcagtatcttcatttgtaagctaagttttctagtaaaaatacaagtacacaaataaagagcattcatttttcttgttttggtttgctttaagataatagactttatttttaggcatttttaggcttacagaaaaataaccagaaaatacagagaggtcttatatagccttgttgttgaaaaaaagtcaaactctgtaaaatatttgaaaaaatttatactgagtcaaatatgagtgattaatggcccatgacactgttacagaaaaggggtcctgatccagaccccaagagaaggtttttagacctcatacaagaaagaattgagggtgagttcatagagtaaggtgaaagcaagtttattaagaaactaaaggaataaaagaatggctactgcgtaggcagagcagcggtgtgagctgcttaactgcttacacttcttgttattaagacttcttggttatatgctaaacaaggggtgagttattcatgagttttctgggaaaggggtgggcatttcccagacctgtgttcctccccttttgggaccatatagggtagcttcccgatgttgccatggcatgtgtaagctgtcagggtgctggtgagagtgtcttttagccactaatgcgttataattagtgtataatgagcactgaagacaaccagatgtcaatctcattgccatcttggttttggtgggatttggctggcttctttacattatgctgttttatcagcaaggtctttgtgacctatatcgtgtgccgacctcctatctcttcctgtgacttagaataccttaacttcctgggaatgcagccgagtaggtctcaaccttattttacccagcccctattcaagatggagttgctccggtacaaacacccctgataacacaacgttcaggagatcctgaggacatgcatccaaggtggctggggcacaggctaattttatattttagggagacatgagacattaatcaaatacatgtaagatgtacatttgttcaattcagaaaggcagggcaactccaagctggggcggcttccaggtcataggtagatttaaaaattttctgattggcaattgattgaaagagttatcaatagaaaggaatgtctgggttatgatgataaaagattgtgaacaccaaggttttattaatatcatgtggatgaagcctccaggtagcaggcttcagagagaatagattgtaaatatttcttaccaaacttaaggtctgtggtgatgttaatgctaggcagtttttcctgaattccaaaaaggaggagggtataacgaagcttgtctgaccttcccttcccgccatcgcctgaaccagtttttcaggttaacttagaaagcccttgtccaagaggaggggtccattcagatgattgggggtgggaggcttagaatgttttctttttttttttttgagacagtctctcgctttgtcacctgggctggagtgcagtggcgcgatctcggctcactgcaacctctgccccccaggttcaagcgattctcctgcctcagcctcccgagtagctgggattacaggtgtgcaccaccacacctggctaattttttatatttttcgtagatacggggtttcaccatgttggccaggctggtcttgacctcctgacctcaagtgatccactgcctcagccttccaaagtgttggaattacaggtgtgagacattgtgcctggctgggacgcttagaattttatttttcatttataccctctcattctatccattttccagtctcaaattagtgtaatacatttgtcacaattgctaaagcaatgttgacactttgaaccaaaatatctaagaggggtctcagtcaatttagaaagtttattttgccaaggttaagcacacactggtgacacaacctcaagaagtcctgatgatttttgtccaaggtggtcagggcacaacttggttttatacattttagggaaacatgagacatcaatcaatatatgtaagatgtacattggtttagactggaaaggcgggacaactctaagggggagcggacttgcagatcatagtagataacagaaaaaatggttacattcttttgagtttctgattagcctttcactgaatgcaaaatttataggaattagtcacttatgcctcagtctggcttagtgaaacaatagggcagatgaaaccatctgatatacattggtctcacaggagccaagggatgactttgagttccttctgccctttgtccacaaggaatttcctcgtgggcaaattgtgaggaagggatgtatgttcgttatctttgcagttatcttatttaggaatagaattttgtctggattgatgggttcttggtctcgctgacttcaagaatgaagctgcggaccctcttaaaggtggcgcgtctggagttgttccctcctcccagtgggttcatggtctcgatggcctcaggagtgaagctgcagaccttcacggtgagtgttacagttcataaaggtggcgcgtccagagttgttcgttcctcccgtccggagttgtttgtccctcctggtgggttcgtgatctcgctggcttcaggagtgaagctgcagacctctgtggtgagtgtggtggcacagacccaaagagtgagcagcaacaagatttattgtgaagagcaagaacaaagctttcacaccgtggaagggggacccaagcaggttgccgttgttggctcgggtggcctgcttttattcccttatttggccctacccacatcctgctgattggtccattttacagagcactgattggtccattttacagagtgctgattggtctgttttacagagtgctaattggtctgtttcacagagtgcttattggtgcgtttccaatcctttagctagacacaaaagttctgcaagtccccacccaattagctagacacagagtgctgattggtgcgtttacaaacctttagctagacacagagtgctgattggtgcatttacaatcctttagctagacagaaaagttctccaagtccccacctgacccagaagcccagctggcttcacatctcagaatgggaggcaggtttgcccgacacagttcccagcttgacttttctcttcgggttagtaattttgggatcatgagatgtattttcctttcataatacattattttttaactaaagtccatagtttctatcaggtttaccacttacattgtacactctctgggttttgacaagtgcatatatgttactatatcattataacaccattgcagatgtaagatgatccagataatgtatgcagaattgatttagaattccagactgcatgatagtatgtttttgtttggttggttttgtttaagatggagtctcgctctgtcacccaggctggagtgcagtggtgcaatctcggctcactgccaccttcgcctcaaagattcaagtgattctcttgcctcagcctcctgagtagctgggactacaggtgtgcaccaccacccttggctaacttttgtatttttagtagagataggattttgccatgttgcccaggctgatctcgaactcctgacctcaggtgatctgccctcctcggcctcccaaagtgctggtattacaggcgtgagccaccttgctgggccactatgtattttttaaacccccaattcaatttctctgcatcaattaagaaataaatccatctgttctaataaaatacaaagaattgaaggtttcttgttgctcactgtattagtgcattctcacagtgctataaagaactacctgagactgggtaatttataaagaaaagaggtttaattggctcatggttctgcaggctgtacaggaagcacggctggggaggcctcaggaaacttacaatcatggcagaaggtgaaggggaagcaggagtcttacacagccagagtaggagcaagacagagagagaagaggtgccacacacttttaaacatccagatttcccgagaactctatcgcgagagcagtactaagaggatagtgctaaaccattagaaactgcccccataatccaatcacctcgcgccaggccccacctccagcattggggattacgattaaacttgagatttgggcagggacacagatccaagccgtatcactcactgtaaaggaagcaatgtcagagacacgaaggccataagaaaaaacggtgtccctattgggagtgtgctatctattaagaacatacattgataagcaccagacgtttgtaatatacgtgggagcataatgcagtttaagaaaacaaagacaagatcgttctgcaacaccaaaagctggaggattgtcatggagcaaaccgaagttcagggaggaaaaaaagcttttttttattttaaataccgaattatgactgcagctctatttttgacttccatgagaggcaattccaaattgacaaactttgtttcccagttttgagaatggactttacctgtggggtgatggagaaagaggataccacaaattctcactgcatagagtagtgtttgaccagttgagcaaaggaaagggtttagtctctattttaagaaattttaggcttcccaggattttctctaggccttgccttgtttgcacaaacacgataaagcaactgtttcgttgatgtcctggtgaaaccacctttgtaaaattgtgactgagacagtgaaagaggtctaacctaaccaagtccatcttgcttctaacctctaagctgtcctttttcactcctgggcgtaggctgaactaactttgggagaaacttagtttatagtttaaaacaaagatgataacggccctttccaaagcagaccttcttcttgcctggggactagactgcctttttaggactaacattagtgcaagattagaaattgtggtttaggagtcatgcagctggaggctacaagattctggccctccctaaactgctcttaagatcagtgcttgagatatcttgcagaccctgcacttgatggatcagctggcaccacccagatcaataaactggcccccatccaggaaccgattcagctccctgaccaatcagcactcccggctcactggcttccccagacccaccaagttgtccttaaaaactcagatcccggaatgctcaggcagactgatttgagcaataataaaactctagcctcccgcacagcctgctctgcgtgaattactgtttctctattgcaattcccctatcttgataaatccactctgtctaggtagcaggcaaggtgaaccctttgagcggttaccttgggcttcttgagggaactaattttcagctttttggcttttttgtctctctgttggggaggtttcatttctagtctgtgtgaaccctccatcttctgcgatgtcaagcagttgctagggaattagttcatatttattactctggctgcagtttctgtcttcaggtctaggactttgagatttcatttttaagtgactatgttttttaacctgcatttccatgtgtcaatggtaagagtaagcgtgagtgcatttgctcagccacttgtgt[137 bp omitted]gaaaccccatctctactaaaaatacaaaaattagccaggcgtggtggcgcgtacttgtaatcccagttacttgggaggctgaggcgggagaattgcttgaacccgggaggcggaggctgcagtgagctgagattgtgccactgcactccagcctgggtgacagagagagattccgtctcaaaaaaaaaaaaaaaagataaataggatggtgtaaaatatcatttccctgtttttaaaacagccatttatagactttaataaagtaggattgattcactcttttacaaaagctatatatatatatatatatatatatatatattttttttttttttttttttagatggagtctcgctctgtcacccaggctggagtgcagtggtgcgatgtcagctcactgcaacctccaccttccaggctcaagcaatcctcttgcctcagcctccccagtagctgggaccacaggtgcacatcaccacccaattaatttttgtattttttttttttagagagggggtctcactatgttgtccaggcttgtctcaaactcccaggctcaagtgattatcccacctcagcctcccaagtacctgggactacaggtgcacaccataatgcccagctaatttttgtatttttgatagagatagggttttgttttgccatgttgcccgggctggtctcaaattcctgagttcaggtgattttcccaccttgatctcccaaagtgttgggaatacaggcatgagccactgcacctggccccaaaccagtatttttttaaagaattttccaaaatgttaacattgactttctgggttgtgagatcacagatactatatgtcatagtatattctttaattatatcagtaattttaccattttgagcaataaaaaaataataatatttgggctgggcacggtgtctcacgccagtaatcccgacacactgggaggctgaggtgggaggactgcttaaaccaggagtttgagaccagactgagcaacatggagaaaccccatctcttcaaaaaaatacaaaaattagctgggcgtagtggcacgtgcctgtagtcccagctacttgggaggctgaagtaggagaatcacctgagcccaggaagtgaaggctgtagtgagctgtgactgcaccactgcatttcagaccctgcctcagtaatacataattacataattaaaataataataatatttaaaaaacacagtggatactattgcctggaaattataagacctttagctgagtatcacatgagagtagccaaaattgattactcaaaattacgttatttggccataggtaaggacatgtaaatttgggaagaatttatgaaaaagagaatgagatatttgatcaaagatgaagatccctgcttctgttggaaaatatcaaagaacaaccggacacattcattgcgattcaggaaaggttttaatgggatgacttcaaagaggaagacatattttcaattgcagaaatggcaagggcacattgttggtgtgaaggcctgagtcggtgggaaataaatgagctaatctaagacactgacataaagcttccaggaaagaaatatggacagtggtgcagtcgtgagaaatgtgtttgatcttgcagaagtggtgtcatttgtgagagtgacaggcagattcacacaagcgcatagaatgcaccctacagacacagagccgacacacctcgcttaaaggggagctggaatttaggatgcataatttagggagaagatgataaaataatggctaaccaaacagcacacacacaaactcacgtgcacgcatggacacacacacacacacacacgaatctactatatcaaagaaaatagaaacagcctgaatttttggtgcacaattttaaaagcagataccgtaaaagtaaatttgagctgcgcgctgtggctcatgcctgtaatcccagcactgtgggaggccgaggcaggtggataacttgaggccagaagttagagactaacctggcacacatggtgagaccccgtctgtactacaaatacaaaaattagcctggtgcggtggttcacgcctgtcattccagctgctccggtggctgacgcatgagaatcgcttggacctgggaggcggaggttgcagtgagctgagatgataccactgcactccagcctgggtgacagagtgagactctctctcaaaaagaaaaagaaaagaaaaaagaaaagggggatggaaaagtatgataaatagagaaaattaatgaaaatgtgaggacctcgaaagctgtatatcattacaggttagggattaactgattaagcaatattcaatctcttttcttttcttttctttttttttttttttttagagacaggatcttagtctatcacccaggctggagtgcagtggtataatcacagctcactgcagcctctaaatcctaggctggagtgatcctcctgcctcagcctcttgagtagctgggactacagctgtgcatcaccatgcccagctaagtttttaattttttgtagagattgggtgggggaggtctcactatgttgcataggctggggtcaaactcctggcctcgagccatcctttcacctcggcctcccaaggctctgagattacagatatgagccactgtgcctggcctgttatttttttaacatatcagttgcacaagactcccacctacagcgaagcaggatgaaaagagattaagctctgatgagaagccattcagtgtggtgtgttaccttctttgtaggatcctgaacagatcaccttatctctagatttcagctttttcagcttcaaaacaaaaagtcggacctgagttatcttgactgttcttactgaaattctctgagtcctgtatgagaaaaaaactacataattttcccctattttgttttgtaatatagaaagagtttcttcctttctattctttgtttagaatacaactttatgttttgttttcaataaatctttgagaatgaggtgttgacttctacgggtcattcaaggtgaattttcattcaggcatttaaaaaaaagaatgattcactcttgggaaatgtcagctgactgagctgccgctcctttttaagtcaggaataagtagtaaagtgcgtttttatacagaatattacctattccatgtaaatctttaataaggcatgctagagggttttaaaagaaatccagacttcatgaaatgagaatatccagagggaaaaatgattgaatttaaagagagagagagagaaaaaaaaagaaggaaccttcagtggtaactgtattcagccaaggggatctgctgatggaattatgaaatccagtttgggaagtgaagtgaactttcccagccaccgactcaaagcacaagatcctaaagtgcttaatgaacagtgaaggctgacctgtgaaggattaggaatttcagacatgtgttacttaagcttctcattcccagaaccaaaattcctcgcaataaaagaaagaaagaagtcagcatgatggctccatcgctgggctgacctcagatcgtgctggtctcagtgatgaacggaaggaatgagaaatcttctaacagattccacatttctggtattgtttttgactcctctgactttgtctttaccccaattaccctgtagcctgatctcactatttcccctgaaatacaacaatttttctctgaaatacaacaatctgtgttaccttaatcagcagatcattgttccatggcaaagtaattattgaggaaagctgtgaaagaaaaaaagactcttgtatatgcctgccaattaattactctgttattgttctgattttcttttctttcttgattttaaccaatctaccccttgttttagggaacggttttgcatggagctgaaatcaaaatttgtttttaaccaaattgtcgttcttcacagaatgtcaatgcaataataccttcaggctcttggagaagatatagtttacaaagggccatttttgtatatgggatcttctcctatacatcttcaacagcttgagttgagccactgcatgcaaactgatgaccttgctaatgacgctggttggttctactacttcactgatcccctttgtcttggtgaatgaatgaaggggtttaagataagaccactggccaatcctgtagctgacttacaaacacctggaaaagtggtgagatgggatcagttatcactggataagcttcatacagaaccttagagaaaatgtcctaaaatctttttaatccagaaaatcacgtttttactgttagattatgtttttgtttaatccagagaattatattttaggttaactgtacacattctatttacctgtactgagtagggtcaaaattatgtttttagtttgttgaattccatgatacttcctcatgctgaattcattgaattgcatgcaaaagattctgaatgacaaccaaaatgtcagctatatgtttattcaaattcatttgtaatgttaattcagtaaaccttttaactgctaggcatcaacctaaggcaatcgtcttctccaattaagaagtatatatgcaaagctacattataattagggagagaatttttgagtttacagagtcataaaacataagtggattgggagataatttttgagtttacagagtcataaaacttaagtgaactgaatgtttcctgactcaaatggatttaagagttcttttctataaaaagaggcgcatgtccttggaaatacagtcttctctcagctgagtagggtgttttctcctctaactcctataaccaatagatatggcagcttggacttaggtcttttatttgctttgtttcatttcattagatgcttgtgtgacacactgcacgtatctggatatgttcacacctccattcaagtcagcatttgttgtatgagtcactgtctttacttaaggcaacgatcactatctctttcggtactgaatatattatattttggtttacattttcccttttgcaattcctcattttcaagttttacatgtaggctgcccatggtctcaaaaaaagcaaataactacataaatgctctgtcttattctcagtaatgacaaccgcatatttgaagatttctggaagattttcctacatggaaatatgtcaatgttgtggggccactgggttatttattcataactatatatctaaaatcaaggggagaggtcagggatgttcttatgagaaataataagaagagtacaatctctgactctgatggtgggtggtgatgttatgatttcagggaaaagtaatctatgaccgaatggtgggtcatgagcatctccatccaggaaaagcaatctatgactgagatgttaagacatgggcatctcagcccaggagaaacagtctatgaacaggacaaagagcgctgatgatcatattcctggttttattagaacaggtctttgcaatgttccactttagcctctagttcaagaatgacttgctgattaacaggctcaagctttcttgacagagtggagtcttggcaaaaatgctgagtagagagtagtagaagcttgtttgggagcctctggtagctgtttctttcagtaatcaggcttcctcaaaaacacaatcctctggcctcactctgcccacgtcagatgtcccacagtgcctgtgctatgtgagcaagtctttcctattttagaaatgtttccttctggtagcacacagtagctcatgtctgtaattctaacactttgggaggctaaggagggagaatggcttgagtccgggaattcaagaccaccagcctgggcaacatagggagacaccatctctgcaaaaaaaaaaaataaataaataaaatagttaactgagcgtggtggtgcacatgcctgtggtcctagctacttgggaagaaaagacaggaggattactcgagcccaggagttcaaaaccagcctgggcaacatagcaagaccccatctctgcaaaaaataaaataattagccaggcatggtagtgagtatttgtgaagctgaggcaggaggatccttgagcccaggagatcgaggctgcagtgagctgtgatggtaccactgcactctagcctgggtgacagagagacaccttgtctaaaaaaaaaagagagagaaatgtttcttttccttactgaggtcaaatcctacatgttccattgttgcttttctgggcatctcccaaatcagtgtaacacattctcattagtggttctggcggttcctctatcaatgtctaggcattcctgcctctaatgctggaaatgcattgtctaggctagccatgaggtgtaggtggtaaaacaaaacaaaacaaaacaggaacacatctgaactgctcctggagtctcaccatgcaaatgctcctacccctctaacaattccacaaccccctactgtatgtagtccattttcatgagctgaattgaagtggacagttctgctttaaactggtggacaggattgaatttggaggaagacactgagttttttttttctctctctctgaatataacgtcttttttttttttttttttcagatggagtctcagtctattgcccagcctggggtgcagtggtgtgatctcggctcactgaaacctccacctgccaggttcaagcaatcctcctgcctcagcctcccaagtacctgagattacaggtgtgcaccaccatgcccagctaattttgtatttttagtagatatgggatttcaccatgttggccaggctggtctcaaagtcctgacctcaagtgatccacttgcctcagcttcccaaaatgctgagattacatgcctgagccactgcacctggccaggatatatgttttctttaaattaaaaaagaatcacgtgaacttcaagttttgaagacaacgtcaaagaacagacacagtccaggactaagcctggagaagagctatttttctcagctctgcaggaagcagtgcacaactacatggcaggaatgggggtctcaggaaacagtaaaggggcccaggtgggatggtgggagaagtttggcacaccaaggaaggctcttggaggatgggcatgagagatgggcatgaatctctttcacctgtcagtacttgcaacatagtctttggtgtctgttttgttttttgagacagggtctcactctgtggcccaggatagagtgcagcggtgtaatcatagttcgttgcagcctcaaactcctgggttcaagcagttgtcctgcctcagccccctgagtagctaggaccacaggcatgtgccaccacatctgactaatttttgtatttttagtagagatggggttttctcacgttggccaagctggtctcgaactcctggcctcaagtgatccgcctgcctcggcctcccaaagtgatgggattacaggcatgagccatcatgcccagctgcccaacataatctttggagttcagaagaatcctggagatttgacttatgagacaaagcaaagcatcattccatattcctaagctgactttacatttggacatacaccctggaacaaagttgacatttaagaaaatacccataaatacaattatctatttattacttacgttagttttgtggaggattcttagcagagcagatgttaagatgtctatgccaatatttatttcactacagagatgtataaaagaatggagagtgcctaaaaaagaaaaggtaatgaaagatatcaaaatagtgtttataagaaagtcaggctgggtgcagtgactctatgcctgtggtcctagtattctgggaggccagggtcgggggattgcttgaggccagaagtttgtgactagcttgggcaacatactgagacctcatctctatgaaaaattaaatattaaacaattaactaggcatggtgacactcacctgtagtctcagctactcaggaggctgaggcaggaggatcgctcccaagcctgggagattgaggctgcattgagctgtgatcgcaccactgcactcctgcttaggggacagagtgagaccctgtctctaaaaacaaaaagaaaaaaaaaagaaattcggcttagtggaggtctttttcaactattatttcatttggaaaaaaacttcactttaatattggtaaataacacacatacatgtagacaaagtttaaattcccagggccagacgcggtggctgacgcctgtaatctcagcactttgggaggccgaggcaagaagatcatctgaggttaggacttcgagaccagcctggccaacatagtgaaaccctgtctctactaaaaatacaaaaaaattagctgggtgtggtggcgggcacctgtagtcccagctactagggaggctgaggcaggagaatggtgtgaacccgggaggtggagcttgcagtgagccgagatcgcaccatgtgccactgcactccagcctgggtgacagagcaagactccatctcaaaaaaaaataaaaaaaaaaattaggtgtggtggctcacgcctgtaatcccagctactcaggaggctgaggcagaagaatcacttgaaccccagaggcgaaggttgcagtgagcagagatcgtgccactgcactccagcctgggagctagaatgagactctgtctcaaagaaaaaaaaattgttcaaattcccaatcattgggaataataataataaatcttcactcttcaagctctggtccttctcttagggatgctctttgtacagagaggattgaaagcatagagtctcatgtccatcctgagagtaacatggcctgagctaccagcctctccacacccctggctgctgaaagccaccctgtgaaacctcaaatctggcttggaattccttctccagccacagatggaaataccagacatgtgttcactgtagataattcagatataaataagttttctaccagaaacgaaatattgtgatgtatgcaattctatcacttggtgtaattaccaatgttcttctttaaggacaacacatggttatggtttgaatagtgacctcctgtcccccaaattcacatgataaaatgctaatccccaatacctgtgaaagtgatcttctttggaagtgaggtctctgtagatgtcatcaagttaaaatgaagtcatttgggtgggtcctaaatccaacgactagtgtcctaataaaaagatggaatttgggctgggtgcagtggcccatgcctgtagtcccagcattttgggaggcccaggtgagtggatcacttgaggccaggagtttgagaccagcctgatcaacatggtgggaccccatttctatattcaaggaaaaaaaaaggatgggggacaattaggacacagacacacacccagggaatatgccatggggagatgaaggctgagataggactgatgtttctgaaaccaaagagtgctcaagatctcaggaaaccaccagaagagagggaggaagcatgagacagtctctccttcggagactcagaggaactgacatggtttggctctgtgtccccacccaaatctcatctccagttgtaatccccataatccccacaggtcaagggcaggaccaggtggaggcaattgtatcatggaggtggtttctcccatatgctgttcttgtgatagtgagtgagttctcacgagatctgatggtattgtaagagtctggcatttcccgtttgcactaactccatcctgccgccctgtgacgaagatgtctgcttctctttcaccttctgccatgattgtaagtttcctgaggccttcccagccatgcagaattgactgtgagtcaattaaatctctttcctctataaattacccagtcttgggtatttcttcataacagtgtgagaacagactaatacaggaaccaaccctgtcaacttttttccatatatatatatatatatatatataatgtgtatatatacacatatgtatttatgtgtatgtatatatacataaaatatgtgtatgcataaaatttgtgtatatatacataaaatgtgtgtgtgtatatatatatatatacacatacttttttttcccataaaatctagaccctgcacaacctgccaaaccttgatctcagacttccctgctgacctgtgtatgtgacattacagccaaacattttctgtcctctctgcttttatagttgagcatctttctaggacaaaactgtaggattattttgcctactatgaacttctggaagagtttatctggatgaaatagaaggaaaaaaaataggagatagatcaaggggtgtgatctttcagcttgcgtcccaacccaggtgatatggtttggctgtgcccccacccaaatctcattttgaattgtagctccggtaatacccatgtgctgtgggagggacccagtgagagataattaaatcatgggggtggtttcctccatactgttctcatgatagtgaataagtcttacaagatctgctggttttataaggggtttcctcttccacttgactctcattgtctcttgcctgctgccatgtaagatgtgccttttgccttccaccatgattgtgaagcctccccagccatgtggaactgtgagttcattaaacctctttttctttataaattacccagtctgaggtatgttatatcagcagagtgaaaacggactaatacaccaggccagtggaaattgtgcaaaggagtttgaactcatcttctttgctttgtgtagaagaaatctcagtatagaggcagaatctgcctccctcgagattaagacagcagggaagagaggcagccccccttccctgaaggcaggtcagaatgaggacatactcagtttgggacccaactttctcaagagaaaaagtcattccttctcccctgggatgaggaaaagatgagcatgagagttgaagaggtttcttgggagaagtggaggggtttctcctatactttttcccctggagagtaaaataaccacactctccctaggaaaacattcatttttttcctacagcacgtcagatctgttaacgaatgttttactttgaactcgggccattgcaaaatcatcagcctgaaagagcggatactcttgcattggaattcactaatgttcagtttgtttacaatgtggctttcctgtccagtgttttaaaattccacatgtataactgaccctcggagaacagttccattgcttagagaacttagcagggtaaccccattgggcagcaggatgacagtagctttgcacactgaaaaagaaacaaaacagattaataaatagggaaaggctttgatgatgagctcaccaatagaggtggagagaagggagggagagtttaaaaagtgctggaggcttctatcctggggctggggagactttgatgaggacacaggctcagttgggttctgtttggcagatacacttaaggaggaactaggaaaaaaccaaaaaggccctggaggcttccaaggaaatgtctctgttgcaatactttggctgcaagatattttcttctgtccccagccagaaggagcaatcctggtgcttaaataaaaaggcatgaaggcccaaagtggctcttgacttgccaaggcagtattacagagaattaagccctaccttagggcatgccaggagcctgctggaggtgtcagtgttactggaaaagaggcccaacccagaccccaagagaaggttcttggaactcgtacaagaaagaattctgggtgagtccataaagtaaagtgaaagcaagtttattaagaaagtaaaggaataaatgaatggctactccacagacagagcagccccgagggcgagggctgctggttgcccatttgtatggtgatttcttgatgatatgctaaacaaggggtggatcattcatgcctcccccttttagagctcatagggtaacttcctgaccttgccgtggcattggtaaactgtcatggtgctggtggatgtatagcagtgaggatgcccagaggtcagtctcgtcggcatcttggttttggtgggctttggccggcttctttgctaccatctgttttatcagccaggtccttacgacctgtatctcatgctgacctccaatctcatattgtgacttagaatgtcttaacttcctgggaatgcagtccagcaggtcttagccttattttacccagcccctattcaagatggagttgctctggttcaaacacctccgacaggtgcagcagagaatgtttacagcagggaaactgttctgtatgaggctatactggtggatacatgtgattatgtatttgtcaaaacctatagaatgtgcaacacagtaaaccttaatgtaaattctgggcttttggggttatgttatgaacccagtgtgtgttcatcattgtaacaaatgttcattgtaacaaatgtactgctctagtcggggatgttcatagtgggggaggctgtttgggaagagggcagagagtatctgagaaatctttgtatcttccgctcacttttgccgtgaacctaaaactgctctaaaaaaacagtcttttaaaaaagaaagaaaagaaaagaaaaagagtgcagacatgttatagcatgggtgatccccaaaagagaatgcttagtcaaagaagccagtcacaaaatgtgtccagagttggttccttctggtgggttcgtggtctcacttcaagaatgaagccgcggaccttcgcggtgagtgttacagctcttaaagatggcacggaccaaaagagtgagtggtagcaaggttattgtgaagaggaggtcgaggctgctgtgagccatgttcacatccagcctgggcaacagagcaagaccctgtctcaaaataattatgataataataataagattagctttgcatagtttatcagacaagaaaactacaaataagtaactacagcacatattctcagagagagagagttcttttgcggggagatgtctttcgtggtttttgttatttgccaactggaaggcccagtaggctggaagaatttaccctaaaggggttcagaggacaagtatactgctatgttctttttaggaggcttttggagaattaattcttcaaatttagagttatttctagtttatgtttttgttttgttttgtttttgagacaaagtctccctccctccccaggctggagtgcagtggcgtgatcttggctcactgcagcctcaaactcctgggctccaacgattctcccacctcagcctcccaagtggctgggaccacaggcatgcactaccatgctaaaaaaataattttttgtattttttgtagagacagggtctcactgtgttgcctagactggtctcaaactcctagccttaagcgatcctcccaactcagcctcccaaattgctggaagtataggcatgagccactgtgtacagccagccgtttttagttatttcacagtaactaaaaagttgattctgaaaatacatgagagtttgcttttaaggtgttggctttgaggtacagttatgcttgctgcgttgagcacacgtgcacttgtattgttacctgaggagcagcaatactaatgtggccatggaaaacgtagaggtggtcttcccaacctaggccacctgccaacaggacccttcttccactccctagggtgggttccctctgtccttcctcccctggttcctgtgaaaatggtcagaggagaaaaaggggttactgtatgggtgcaggatcttctttgctgcgtgttttagggggcgctgcagacatctcagtatggtccatgttctcctgcacatttagggcttcggaggggtgattgccacagctcaggctagagtgcatcacccaaagtaactctcagcctataaactgcacttttacaagcagattatagacccgtagcattggcatgtttgatacgtctgaacacagaactctgatagtaaaatctcaacatgattcttgctggacaggccagttctctctgtgtatattctaggttttgagaaaccacaaccagagccccctggctccacgtccaccatggtttttcccttgaatggtgctcccagaagctttctgggttacacactagtggtgtctctggatttagtcgtgaagttcctggaaaaaattccttttccctaggctactggtgtgagttaaattctactaggagttcctctgggctgtttcacttcgttatttaaattttaaaaaatattttaattttttgtaacttttatgttttttaaatgttgttttagattcaggggcacacatgcagctttgttacatggttatattgtctgacagtgagttttgggattctagtgtacccatggtctgaatagtgtacattgtacccatgaagtaatttttcatccttcacctccttcccacccttctgagtctgcagtgtctattattccactctctgtgtctatgtgcatgcctatttacctcccacttagaagcagaaacctgcagtggctcttatttccatctttatgtccatgtgtacccagtgtttagcttctacttacacatgaaaacgtatggcatttcatttactgcttctgagtcatttcacttagaataatggcctccagctccatccgtgttgctgcaaaagacatggttttattcttttttatggctgtgtagtattccatggtgcttgaatgtacatatgtatgtacatgggtgcacagatgtatgtacatacatgcaccatggaataccacgcagccataacaaataataaattttaaaaatatctatctctatacctctatatatctatacatctatatatccatacatatctatatatctatacttctatatatctatacatatctatatatctatgcctctatatatctatatatctatacatatctatatatctgtacctctatatacctgttattaggttggtgcaaaagtaattgtggctttttctgttacttttaatgtgaaaaactgcaattacttttgcatcaacctaatatacatgtatgcatatctatgtctgtctatatacatacacaccacattttcttgatccaatcatctgctaatggacacttaggttgattccatgactttgctattacgaattgtgctgtgataaacataagagtgaaggtgtctttttgatataatgattactcttcttttgcatagataaaagtcctagaaaaaactcttccatgttttaacatccaatcctgtctcaccaaccgtggctcagaaaccactattgctttctggattagaaaaactcatccagttcttgtggattacacactaggaaccagttttctgcaaaaagcaaactactccagagaacagtcctcttggtatcgttccagttcatgaacagccattgaaaatgatgacgaaggtggtcatttcaacgccagcttgctgtggtttcgaaacagcagagcacgaatgaagcccaactaagccctcggtgtgttaatccaatgatgatgtcttcaccccacatcaccttctttatcccaacaatattcccgaggcaatacaagaaaaaaggtgtatccgtttcctggccattcgtgggtatattttagcctcaaaaggggcatgtggacatgaaaataggctctttcagagtaggggaatttatcttcactaaaaatttggatcttttgttaatcacaatttttttcattcactttgattttttatgatatggaattaaagtatttcatattttgaccactgaagttttggtgcccactgaaattttgtgctcaaagcagttggctcaatttccccaccctagccctgtcctgggcaccactgctggctaaaaattctatttatacatacatatatattatgtttttagacatatagcgtttgtacatataaaaaattatgtatatgtgtatgcatgtatgtacatatatagatggtccctcatttaagatgggttcaacttacagttcattttttattattttttttaagacaggatcttcctttgtggcccaggctagagtgcagtggtgcaatgatggctcactgcagactcaacttgctgagctcagggatcctcctgcctcaacctctcaagtagctggggctgcaggtgtgagccaccatgcctggctaaatttttattttttgtagagacaggatctcactatatggcccagaccagtctcaaactcctggtctcaagcaatcctcctgactctgcctctcaaaacaataggattacaagtgtgagttaccacacctggcccagatattcttaacatttttgttttttaaatagagatgaggtcttcctatgttatccagactggtcttgaactcctggcctcaagcaatcttcctgccttggcatctcaaagcactgggattacaggcatgagccaccacacccagccaatttaggacttttttgtttttatgataggtttatcaggatgtaaccctattgttaaacatgtaaccctattgttaaacaaacagtatctggacttaacgaaggttcaaattacaatatttcaactttataatggttttatcaatgcgttaccccattgtaaatctaggagcttctgtatacatctgtgtatatatatatatatatatatatatatatatatatatacacacagattaaaaattacatatatatacatgttatattttatgcatatacatatgtctatcttatatagttgcttaaaatgttatacataaataaaagatatatatatataaattaaatatcatgtatagagttggttaaaattttatatgtgcatgtaaactacattttatatatatatatatacactatatatataatattttaatattatcgtcagctgtggtgcctagggcagggctagaatgtctaatgacacaatctcatcaggcacaaatttcaggaggtaccaaaaaactgaaactaaactccatagtcacgatactgataaatattcaagacgtatataatgttttaattatacacacacatacagacagtgctaagagaccattagcttttttctcataatttagacaaaaccacttttgcagtgggccctgctgtgaaagtaaagggttaatgttgctcaaagaggggtggggcatttgcccccagctcctgagaggtgcacactagccttggaatgtcctgcctagtaggaatgtgtttatgtactgggggacctggggtaactggacaatctagcaatgtgatttagggtagagggggctattcatagcagagatttttagagtatgagatggacatactaggtgttaacaatatggttaagggtgggagctttgggtcttgaagtatcagctcagacctctggagaggctacagattgaggtcaactctgtgggccattgactgtggagccccagctgaagactctgaacactggggtttgggctagctaccctggttggcaatgcttcaggcattctgcacaagctaagactgtgaggctccgtgctgtccacaactccacaaggaaaggacagaaggagctctgtgtctgcaacttttcctggattctatctgtcccacatccctcttctcttggctgctatgtcaatctgtatccttgccacgtaataaaccataaccatgagtgtaatggtgaggtctgtcatcctatccaaagagccaaactgagggttgtcttggggaccccaaaatttgcagttgatgtcagaacagtgggtggtcatatggggattgtcccctctaacaatgaacttgaccaacccttacacctaccctgtcttagttggaatgcatgaaatggagactttagacattcctttcaatcttggatgttatgattttatcaaaacaaagtctattatttttctttgcaggtgacagagagagagagagagagagagagagagagagaaagaaacagagagaaagaaaaagaaaaaaaagaaaaagcaagtaagaaaacatgagattgggcaagacagagcccatctcatttctctgtgatttggaggtatcgaataagattctaataagaactgtgtggtatgattggaattcaaactatcaaccttgaagttgatgacagtgcataacgggcttttggtttgcacatctttctggtaatttatcctctttagttccttgtctccacacatctgcttgtgcttagatccaaaggaagagacattaggaggctataatttatttttcagggaggaattaggaagtgaaccaatgtcccattacatttgcatcagtttttgattaaaacacacacacgccacacacatttctcacactgtgagcaccccacactcttgtgtgggtatttttgttgttaattaaatttgtttctaaatagacttccatcctaacctggctttcatgcttagaaagacaagtgataaactgcaataaccctttcacatactttgatacaaatggttttaaacagttgggaagattaagaacaaagaaagcttttaaaaaaaatttctgaacctccaaaggttttgaccatttcctcattattattttgtctgctttgcacatgatgaaatcagaaatgggttataaggtagaactgtagttctgactttccaagaaaaatagtggacaaaacctgaagacaattttcagatgcaggatttttgtgggtgatgcagtgtgcgagggttatggcaccattaatccttgtactgtgggctggtgggggccagcatggtctggcgattgccaggtggattgaaaccacagtctcagatttcagggaatggcttctttcagtaacgcctacacccacatgccatgtggctggaagagctgcggaggggcagaataaaccattttttaatttgctgccttgagaaagatgcacacatccacttcaataccatcgtttttataaacccaggcaaatatttcagaagtgtgtggagcgtaggcgacaagttgcattcatggctgagttactgatgttttaatagagccaatgttgacttggcataatttttatgcttcataaacacaatttattttaccgacaaaatggagtcctgcaacaattttgctctggaggaatctgctgggtgaagcaatacaaattctgagcctcttgcattgaataaatcttggagatttgaaaattcttatgatttgaccatttttattcattcaaaaaaaatggtggcttatgcctgtaatcccagcactttgggaggctgatgtaggtagaacacttgaggtcaggagttcaagaccagcctggccagcatggtgaaaccccttctctactaaaaacacaaaaattagcaggtcgtggtggtgcatgtccgtaatctcagctacttgggaggctgaggcaggagaatcgcttgaacccaggaagtggaggttacagtgagccgagattgtaccactgcattccagcctgggcaacagaacgagattctgtctcaaaaaaaaaaaaattgccacataaacataatcaagtatttgtttttttttcacaatggcgagggagacatttccaacacagcatgtatcttttatatttttactggcttctgaatttttcccacaacaaagacatcttgttagactctactctcatgaaagtatattatgcttgacaaggtgccattgaagacctttgcagctgtatcattaaatgatacatttattacaattcctgaagtctctgcaacctcagatacaataacctagcacattggttgctcaaaagtaaattgacgtccaaatgctgagttagcactttgagaagattacttattcgttaatcttagaggggaggacttagttattggcattcataagcgtcctttcaagtaatcaatgcagcattttgacatgaaaaacggattatggaattttccatgagaaagtgtgaagaaggatttgattttcttaagtgcatctaaagaagctaacattggtttggaatcgatcctcttaaccacaaatatgattgctttattacaacttagggaaattaaaagaaaaataaaatacgtctcccaaaacaatagcatggcttgagagaaaatctgagcgcaacaaatttcattagtcttctcaggttttgaatgacttcttaaatatttgaatcttcattagtttattactgtggttgggaaacaatgcctttataatgttaattgagcacactgtttctggaattctgtaagctaagaagccaagttggtggaggatgacatcttgcaaatgactcaaggagactggacacaaaaacattcatgcattagaaatcaggggttcaacatgcatgcatatgttcattgcagcactgttcttaatagcaaagacatggaatcaacctaaatgcccatcaatggtagactggataaagaaaatgtggtacatacgtaccatgagatgcatatacagccataaaagagaatgagatgctttgctgggagatggaaggagctggaggccattatccttagcaaactagcacaggaccagaaaaccaaatgctgcatgctctcacttgtaagtgggagctaaaggatgagaacacatggacacatagaggggaacaacacacactggggtcttttggagggaggagggagaggatcaggaaaaacaactaatgggtactaggcttaatatctgggtgacaaaataatctgtacaacaaatccccatgatattagtttatctatgtaacaaacctgcacttttacccctgaacccttaagtaggccttggcatctgttgttcccttctttgtgcccatatattctcaacgtttagctccgcttctaagagagaacgtgtggtatttggttttctgcgcctgtgttaatttactaaggacaatggcctctagctccatccaggttgctgcaaaggacatgattttgttcttttttgtggctgcatagtattccatggtgtatatgtaccacattttccttatccagtctaccattgatgggcatttagattgactccatgtctttgctattgtgaatagtgctgcaatgaacatacacgtgtacttgtctttatggtagaacaatttatattcctttgggtatatacccaataatgggattgctgggtgcaatggtagttctgttttaagttctttgagaaatcaccagactgctatccaccagtggctgaaccaatttatattcccagcaacagtgtataagtgtcctcttttccctaccacctcaccagcatctgctggtttattttattttatttttatttttttaactttgtagtaatgaccattctgactggtatgagatggtatctcattgtggtttcaatttgcattttctctgataattagtgatgttgagcttttaaaaatagatttgttggctgtttgtatgtcttcttttgagaaatgtcctgttcatgtcttttccctactttttaatggatgatatggtggggctctgtgtccccacccaaatctcatcttgaattgtatttcaaattgggttgagggagggacctggtaggaggtgactgaatcatgggaatggcttcccccatgctgttcttgagatagtgagtgaattctcatgagatctgatggttttataaatagcagttttccctgctcttgctctctctcctgctgccttgtgaggaaggtgcctgcttcccctttcccttccaccataattgtaagtttcctgaggcttccccagccttgcggcactgtgagtcaatttaatctcttttccttataaattacccagtctaggatagtatccttatagcagtgtgaaaacagagtaatacaatggagttatttgttttttgcctgttaatttaagttccttttggattctggatgttagacttttgtcagatgcatagtttgctaatatttccttcctttctgtaacagcctgttctgttctacagatgagtccacaattctacatctgttggggaataatgaagagaaacaaggggcacattatttttcaccctgtatggaaactatggtgtacttcttgctctttcaccttcaggcaaaatctgataaaatgtatcagaggacatttagttgcctagaaaattatcttgctcctccagctgtctgagatatataatgagataccaactcacaccagtcagaatggctattactacaaagttaaaaaaacaacagtagctcataattaacttttatgcaaaacataatatgaactccattgagattgaggtgaaatttttaaaattgtcatttttatgaaacctcagttcttgcacagtttgtatttcttttgagtactttttttcttctgtggtttggaaatgtcttatttgtttgaaagattatatttgttctctaagatgtagaatgattccacaaaagaggtggtgcagttaaggtactggtcaggaatttacactcagtggtcatgagtcttcactttggaatatgtttaagtgttttaaaaatctattatttgatgttagcatgtattatctcatctaaagacaatatgctgaaattattattgggcaaaggactttacaactggaagaaaaggggaaggaagggagggggaaggagaaagaaaagagagttaaaggaaggaaggagggagggcagaaaggagggatggaggaaggaaaaagaaagaagggaaggaagggagggaggaaggaaagaggaagaaagggagggagagtgaggaagaaaagaaaggaaggaggaagaaaaaagaaagaaagaaaagaaagaaggaaagaaagaaaaagaaagaaagaaagaaaggaaggaaggagggagggagagagagaagggaaaggaagaagggagggaaagaacgagggaaggaaggaagaaagcaagaaaggaaggaagaagggagggagggaggaaggtgatgatgttaaagagaataagaaagaaaccctattaccacaagaaccattaacaaatctaattttttttttttatcataggaggtgctggccattccaggtaccatgaggccaatgaaatcaatgttctgtcctttccttcatggtactgactgaagatctttatctgatgtgttggatcacaggcacaggcagggacaagagacaacttctacacatgtcccagcctctgcttcactgggaacaagaagttgctctgaaggtaggtaggagaatagattagagaaggatgggcagccataagagaaacaggcattgatgtggttgaaatgtttttaaaaatatgcttatgctgtacacacatgttcacagaagcatccttcacaacagtcaaaaaatagaaacaaccaatgtgcatagacgaatgaatatgtgaacaaaatgtgatccatccatacaatggaatgttattcagccttaaaaaagaagagaatcctaacatattctacagcatggatgaaccttgaggatgttttcctgagtgaagtaagccaaccacaaaaaggacaaataccatatgattcctcatatatgagagccttagagtagtcaaattgttaggggtagaaagtagaatgttgattgccagaggccagggggagaggaattggggcattagtgtttaatggggacagagtttcagttttgcaacatgaactgttctgcagatggatattggtgatggttgcacagcaatgtgcctatacctaataccactgaactgtgcacttaaaaatggctaaaagagtaaatttcatgttacacatattttacacaatttaaaaaaatgcttatgatgtggagtcaatagtcatttttgagataattttcaagatcaaaatgaaaaagaagaaatccagtcatcaggattgagttccgaactgatcaactgggtaatgagatgaagaacttatttatttttacctcaacagctgggccacttggcttcttcctgacatttgcagagagcatctcactgtttcatttgctcctggtaaaaacccctagaactctttctagacaaagcaggaaccaccctggggtggtgaggtggggacttctatcatgggagttaggacaacaaggagacagaagtccaggatgaattcagatctcccccgtggacttagagggcaaaggaaagttggcttcgatctgtggagtaatgcgctctaaaccctgtgactccagaagaacaccctcttattttggctgttgtggtggttctgagctgaacagcctgcctcagcccttacctagagggacacgtagagttagataggctctggtttgcagagtctttcgctgggctgtctccccatcagcaagagaaagagctctccaaaactgccagggaagcctgagcctcctaggtgttctaatctgcctagaaaaataattccacaatgtaagtaaaccgccagatagttgagggaaattaacagtatgaaccagttctaaaatgaacaaacagaaggtctgactctcatgagaggtgcaaggttggagataaccagttccatgcataattgtgtctttccacaatgtcagtcttttattgacgctattgcaattacaaaggccacaagctgcatggagttcccaaggaggcaattctccttagtgcttcctgttcacttggtagtcagagctgcgggcacacaggttcaagccactccacatgtcagttgatattgcaaaccatacataatgattatatattcaataaataaatgttacggattaaacattccatggcaaacaaagtaacatggaacatcaagaggaaaaagagataggagaaatggctaacaaagctgggctcggtgcctcacacctgtaatcccagcacttttgagagactgaggtgagaggatcccttgagttcaggagtttgagaccagcctggccaacatggcaaaacactgtctctacaaaaaaaaaaaaaaaaaaaaaattaaccaggcatggtggtgtggtgtgcgcctgtagtcccaactactcaggaggctgaggcaagaggatgtcttgagtccgggaggaggaggttgcagtaagcaaagatggtgccactgctcttcagcctagacaacacagtgagacccctgtgaaaaaaaaagaaagaaaagaaatggctaagaaaccagtctaaatagagtgatgtggacaagaagaatgtcatggtctgggcctggctgtgcatcagtctcgcaaggcaaaggctttgatgtggcacagcctttggtggctgatgccaagttcttttcaggagtgacagcaagacagttgtcagttaagacaactgttttgagttgctgaagtcctgctctttttatgaccacagaatcctctgttgagggttgatggtagaagaatgtgcttggttatgtccttatctggttggatgcagtctttatttttttgtttgtttgtttattaagcaaaacctcttatccttctttgcacagggccctgtgaaacatcaaatggagtctttttctaagatgcagttagttatgccaagggtgtttgatatggtttggctgtgtccccatccaaatctcatcttgaattgtagctcccacaattccctcgagtcatgggagggagctggtggaaggtaatgggatcatgaaggcaggtttttcttgtgctagtctcatggtactgaataagtctcatgagatctgatggttttctaaacggcagttcccctgcacacgccctcttgcctgctgccatgtaagacatgcctttgctcctccttcaccttctgctgtgattctgaggccttcctggccatgtgggagtgtgagtccactaaacctctttttctttataaattactcagtctcgggcatttcttcatagcaatatgaaaatggactaatacagtgctgtatacaagaaccctcctggaagaaatgtaggtcatgcagaagaaacaaaaagaattcagagaactgaattagtaccctgaagcctctgcactccagcctgggagacagagtgagaccctgacttgaaaaaaaaaaaaatgccccaaatgtcagtagtattgaggttgagaaaccctggatgagattcataaaagccaatgtctccttagtaagcatttcaaaacatagaggaaaaagacagtgattaaaagaatataatccaagaaattatgtgtgtatatatgtatgtaaatataaatgtatattttctacataagtataaatatataacattaaacttaattatttataaatatgtataatttctttgaccacatatacatatatgtatatgtctattttataacaaaatctattaattttatgaatataaataaaacatttaaacatgattagatatgcaactttataaatattaacatttaaatacatctatttctacaattaatttacagtagacccctgagcaacacaggtatatgaggattttcctccgcctcggccacccctgagacagcaagatcaatccttcctcttcctcctcttcctccacctcctcaatgtgaagatgatgagaatgaagaccttgatgatgatccacttccacttaatgaatagtgaatccatttcctcctccttatgattttcctaaaagcattttcttttctctagcttgctttattagaagaataccatatataatacatataaacatacacgatatgtattaatttactgtttataatattggtgaggtttctggccaagatttcttcccagttctgacattaaaaaatgcttcctgaacacatgttgttcaaggatccactgtatattaattatataatgtatatatttataaagtataaattaatataactatattatgaattaaaaatttataatataataaagtaataatttatagaaaataataataaattcataacaaatcaatattatgatattgtatatcaatatgtaatatagtatattaatattatattaatatattatagtataatatttaaatattataaattataacataactgtatattaattataaaatgttttatatgtatgtacatgttaatatttatgtagttatatagctaatgtttacatgttttatttatatttataaaattaaaatatttcattataaaatagacatatacatgtatgtatatgtggtcaaagagattatatatgtatatatgaataggttgtttgtatttaagttttgagggagtccagagttacaggtggatcttcaactgtgcaggggtcagtgcttctaacccccccacattgttcaagagtaaactataataattaatatattgattatacatcatatatttagtatatattaatagatacataacttacggaaaacatccacttacatctttgaattgaaaagtgttactaaatgatactaagaaaaaaacatgctaagaggctgactaccatagattgcagaaaagtccaccattcttatgacacaatgcatcaagaggtagagtcgcttccctctccactgagtgtgggcttgccctgggatgtgctttgaccttgaaatccggggaaagcaaggtcatgctgattccaagccttgctgcaacaggtttgcagcttcctttctcgctgaatttggaatccagccaccatgtgaagaagtgcaaccccacctgctgtgtgacgagacaagggacacatttcccctattctcccataagcggggccacctagctgaccagcctgctgaccacagaaaagtgagtgccccactgagccctgcccaaattacccacccagagaactgagagctaagcaaatcagtgttgtttgaagccactcaaattcagggtggtttgttactcaacatgaactaactgttgcactggtaccagtgaagatctttcttctccaagatgaaaataaaattaagttacccaagttgcaaccacaatcagaaatcatgaaacttctcaacagcaatagtggatgctatgagacaatgttgcaaggcatgcagcttcctgtgagaacaatatttttttcttctagaattccaaatctggccagacttgtgaatcagtatgagggaagaaaaaaggaagagtttttcatctgcgaaaggttagaaagttttcattccaaagctcttttctgaaaacaagacaaaacaaaaagtaaatacttgatatattccagattaagaggaaataagtggtaaaattcaaaaagcagctggattaatccacttggattaaggtagaacaggaaatcacagggctcccagaagaattttgtcagggaggaattgcatatctctaggctagagggggattcaaaagtttttttacgtagagatgaaagcctgtgcttcttcaacaaaaggaagataatctctgggaaagaaaaaattacttgctgttcaagaagcaaaccaaaatgtggtaggtcttttttgtttttttattttttcaatgattaatcaaatgtaagaaacagtaattctagaaaaaaacaaaacaaaacagaattcttccttggccaggcaattcccaaagaaagaaaaacccctttgaatatattaaattctctttggattaatagcagagtttcaattaaaataatttcctcgtgttgggtgtagtgatttcccactttattagatatattaaattttcttagaggatcatcttcagcctttaaatattttcttctttaaaaaaagtttaaagaaatttttttcttcaactttaaaatttaaagcttttaattttttcttcttttttaaaaaaattttaaccgagtgcttgttggattgtttatttagatatcaattcagccttatagttttaaaatcaaagataaaaactgtattttgctttttgaaaatgctaagctcataaaacattgtatagttttaaaaactcactattttcagagttttaaactttttttcttaacataattgtaggcattgttgttttccttagcaacattgattactacatatctcattttgtgatattcagtttaggtatttttctttccattcaataacatatattttcctttaaaataaaaaaaaacagcattaacagttataatttctgaatgaagcaatgagggacaattttaattttcttcttatactttttgatttcatgaattttgtctataatttttcaactagaagaaagcaataatcaaaattgcatcatggaaggtttccattgtcttagagagggagaattgagtttacctctggggcagactttcatctggcatctaacttcccattgatgaaatgcaggctccacgccaaacgtgagtctatctcccttatgtaaaagggatgcaatgagaaggggtttggggtgcaggctggactctcatgactttgcagggacctcaaccctaatgatgttgccaacaccataatcattgctgttgctcttggagcttccatatttatttgctagattttcatgcacttatttctgtgtcaaattgtctcctggcttcactgtttcctctgctagaccatcaatgttgtctacagctgtatttctggtttcatcttttaatgagaagaccattgttaaagcaatgacccatggtgtatgatttcccagtctagaggcctctcccaagctcacttttcttgaggtctctctcatgcaatgatcaatcatcactgtcctgtttgttcttcttgacaaatgatcactctttggctgggcatggtggctcctgcctgtaacctcagtgttttgggaggccgaggtgggaggattgcttgaggtcaggagtttgagactagcctggacaacgtagtaagaccccatctctaccaaaaatattcccaccctttgtcattcagtccaagggatgctttctctgtacttatcttccaacagccacatctctgtccttgaatgaatttagaccttctgtttttatctgacagcacattgtggagaggctaaacatcttatctaaatgctgcagacaataaaaagtctagaaatgaattcaatgctgcagtcggcatgatcaatgtggttgtcacagagctcactattggatgtgcctgtatctggttccagactatagggtctgcacaaacaaaaattatgtttgggatgatttggatttcttccatcagttctagctgaaactgacgtaaaatatcaacctaacaaattcacacaataaggatgcacgtgatgagaaggtactaggcatggactgatgagactctggctcttaatgttaattctgcctacatactagctcctctgatgctctttagatagaaaccagatgtcccaagcaagtctgacagtatctgcaggtgacaacaaagagagagggaacattttttttttcttttgagacagagtctcgttcttttacccaagctgcagtgcagtggccccatcttggctcactgcaacttctgcctcttgggatcaaatgatcctccagcctcagccttccgagtagctgggactacagccacatgccactgtgcttggctaatttttgtattttttctagaaatggggttttgccatgttgcccaggctgttctcaaactcctgagctcaagcaatcctcctgcctcagtctcccaaagtgctgggattacaggtgtgagccaccatgcccaggtaggagaggaaacatttgctaatagcacctgatatggtttagctgtatccccaaccaaatctcaccttgaattgtaattatctccatgtgttgtgagagggacctggtgggagatgattgaatcgtgggggcgggtttttcccctcctgttctctttagagtgaataagtctcacgagatcggatggttttataaaaaagcagttcccctgcacatgccctcttgcctgccaccatgtaagatatgtcttgcttccctttcgcattctgccgtgattttgaggcctccccagccatgtagagctgtgagtccattgaacctctttcctttataaattacccagtctcgggtatgtatttattagccgcatgagaacagactaatagagcaccccagaaaatgtaaccttatgtgtctttagacaaagtggtgttgtatgcctgtgctcaacccacacgtggcacaagaaatggaaccgctcatggttagctttgatcgaccagcatctgatcaaaagcctctcttggaatatatgacctcagagaagtagaatgttacccctccaaataaacttggaccctgccagcaacaattatgtagaaacaggatgtaggttggtatcagtggctcagtaagagtttcccaaatgtatgtagtatcgtatcctcaaaattatactcatgtacaattactttgctgaggagctacaaggaccagaacacccaagctttttctaggacacatacagttgactgggaagaatcaacagagcttcttttttttccttctctatttagaaattctttgacctatttccattttctttcttgtgtaacctgttaatattagccagaacttctgtcagggcgcttgccttgggtaatttcgaaatactgtgcatccaacatcatgaaaattgcagttcatattagcttgaataaatgtagtccacacagagagggaacgttagtgctggaattcctttgagtcccatttccacagttcttggatctttaaatccatttggtttcaatgatagtcactatcttttgtcagaaccgacgtttaggcagctagcccagctctgaggtcaggctttggtgcaaagataatgggagatgaagattcaaatttcctttgtatgaaacatgaaccctttagcaatgtcctatgactttctatagtgatttctatttggtcacattttgcataggcaagaagaatctctatacttcatagcaatattatctttggataaggatgggggcagagttcatcttttcaaggtttgaaagaaaatgattttctgcttctaagtgaaaattcctgctgaggtataggaatagccttatcacacatagtaatacaaaaacagtacttcacgtgatcagaaaccccccaagtaattccatctttatttgtgtctcaatgcttgagattaaattatgcaattatttggatattttgtgtttaaaaattgaaggaaaaattggattttattgtcagtaaagcttgttagtctacaatgttaattgatacgtattgaaatctcagttatatgttacatatgtggtcatatgtggtacatgttagagaccataaaaatacaatctgaatgtttaaaaaaagaaagctgcaatatattttaattctgggaggctgtgggttatgttttataactctcccaaattaatcagggtccacattgactaaatacttgtgggttaattatttccttatatccttattattgtttttacaggcatattttctgctttcatgtgatttctttataactcctgataaaattaagcacaagataaatcctcgatgtaatgactaggagttcaatggagtacaataattaatacctgtgtccttataccttatagggtgtcctatttcatttttttgaggcagagtctcactctgtcgcacaggctggagtgcagtgacgcaatcgcagctcactgcaacctctgctttctgggcgcaagttatcctccagcctcaggctcccaagtagctgagaatacagccatgcactaccatgcccagctaatttttgtatttttagtagaaatggggtttcactaggttgcccaggctggtgttgaactcctgggttcaactgatccgcccaccttggcctctcaaagcactgggattacaggtaagagtcaccacagctgtgtcttattaaatatccattatctttaagcttagttcttttttcatctcaggtgggaatattgtataacatttatcctcattagttcttaagtttgaattaagtttgaataaatttaaatacatacgtgtctatactacctagtttagtgagttgaacattgacagcctgttttcttgactgtaacatcctgattattgaaggaggagaactatattatcatatataaacctatatctcaggctctgcgattttcccctctcttatttgcagtagaaataagtataggaaaatcagagatcgtgacatattgacatttctgtgggctccactgtgggtgagcattgttgaatgcgttggaataagtggcttgacttttccatcatccacccagggtgatgagaaacatgtgctatttggaggatgcatgtggcatgaccgaggctcagaaccgccatagggctggtgatgattggttggttgtcgtcttttgttttgtgctcttcccctgagaaaaacagagggcaattgaggctctccacttctaagttctcatttaatggtacttctctttgaattactcttctaaaatgtcaggtttatggagccaaggcaacaatattttaggatccttctgtctctggaaaagaaattaatttttgatctgaaatgaaagcactgagtatttaaagtcaggagaaaagaaaatgtgaagtgactcatgtcccctgggcattggtaacagtccacccttggtttctttcctagcaatatggtggccatattttcccaaccaagctcaacccacacaccaagggcctgggagggtatgggagaaagacagatgttaaagccaggaaaactcacattggaggtgttgtcctggaactcatcttttatttctatgccatttgctttccagttaccctttaaacctgcatctcctcatctatagagtaagatttgttatatgtgcttgctactttttgttgtatgtctgatgtgacttaggattcaataaatgcacgtcttcattcctttctcttcctattccatctttctcttctttgagcaattcccatctttcctttttttctttttttcctccatgtgggtaaaatgagaagtttcttttttattttctttttgagacagggtcttgctgcatcacccaggctgaagtgcagtggtgtaatcacagctcactgcagcctagacctcctagactcaagtgatcctcccacctcagcctcccaaggagctgggactataggcatgcaccaccacgcccagctaattatttttaattttttttaagagatgagggctcactgtgttgcccagcctggtcttgagctcctgggctcaagctcctgcttttaagcaatcctcccaccttggcgtcccaaagtgctgggactacagatgtgagccaccaagccctgcctgagagaatattttaaatagggattgatctaaaacgttttagttatgtggccctcaaattagcagctactctgtctccttggcaggaaggagtttgggagaagtcttttgggttcctcaccatcaccatatagacccctgcccttgggctagaaaacatttatgaactgattttttataaacctaggtaggttgcatattatatttgaggatagagccatgcttataactggacccaaagagtttagcaataagcaaatgtgcttctatagagtgaaaatctcaactcaggcaggaaatgttctccacatcatagtcataaatagcaataagaaattggccctccatctgctgtacaggtagggggagcattgttaaaaattaccagctatgcttatcacatagtcctcacctaatagaaacagagagatttgcttttgattcaaccacctcctagagatactaaaatccatggatgctcaagttcttgatataaaattgtgtaatatttgcatataacctgtgcaaccctcttgtatactttaaatcatttctagattacctataataccgaatgcactgtaaatgctatgtaaatagtggctatactgtattatttatggaatgatgacaacaaaaagaaagtctgtacttgtttagtacagatgaattattttttttagtatttccgattcatgagtgtttgaatccacagaatggagggctgattgtgtaattacttcttgctattctctttttttttaaattttgaaccttctgtgggaggattgcttgagccaggagttcaggacctgcctggacaacatggtgaaactctatgtctaaaaaaaaaaaaaaaaatccagcagagaggtacacgcctttggtcccagctacctgggaggctgaagtgggaggattgctggagcccgggaggttgcggctgtggtgagccatgattgcaccactgcactccagcctgggtggcagagacagaccctgtcttaaaaaaaaattagatatagtctgataataactacaacatccctctgttagatccctaagatctttttctacattattcagagggaattattttgttagtagccttctattaatttcttaaagggcacacacgcacacaaaagattgaagaaggttaatgctagatccattattttaagtgatttaatctattcctttttttctctccagaccgtctcactattttccttctgaaagcatcactagtgaattcagtcacaggtacgatgccatcgaaaacaacgcatgcaattcatgcaaaataaattgggaaagccaggtggggaagtgtttgttgttcctgccagcttatttttcccactgtttccagaaggaaaatgaaagacggggtgaggtgttgcccaaggcacatcccgtgtcctggcttcattctgttcattaccacccacctggtcccccttagccagcccacagtctcctggccacacaagcttcatccaaaccaccctctgtcagctgttgcccttgtcacagccgtgctgctcttcctgtttccccaacacctagccagggcccacttgtcattgccactgtttctctctggtgctcctggtctccgacacgacctcagatgccctttgccacggaggaggaaggatgccttgcccaagcgtacaagacgtgaaacagcttcaccgctatgtcctctccatttctgggctccttttctatcttatgtttgccccctactcacagcccttccccattaagaaccaacctccaaccgcatgccagttgcaacatttctgatgatgaagtgtcaccgaagtgggcctgattgaagaaggtaaggaattggcacatggaataagaatttcaagtgttcataacaagaaggggagggtttttttttcttttcttttttgcaaagaattaataatgaaatggtgggatgcctctaactacacactttggcctcaccctgcattaactcctgaactcccagctatgtgcctgccttctccttgtactagagcctatgaacacttcataaggaagaaaaaatcagagcatccttagccatgctgagaaacagcaatgttccaagctttcctaaataggcacatagatatgagatatctatatctatctctatgtctatctagctatatatctacttatctgtctatcaatttatcaactatcattttattcgatcacctatttacccatctatcttctatgtatcccatctatctatccatctatcctatatatgtacctatccatctatatctatgtatctcatctatctatccatatattatatctatgtatgtatccatctactctttctatcatctatctatctatctatctatctatctatctatctatctatctgattcgtccttccatctgtccatccattcatctatctctcttctatccatctattatctatccaatcatctattaactatctcatctatctatctaatcatctacctataatctattgactcacctattatccttctcacctatctatctataatcaatatgccattcctagaaagtttcaaagggacaatttggaaatttgcaagtgttctctccactaaccggagaagtcagaatgggatgaaaccttcctttgtggcaactaatgagctgcctgacttcttggaaggaaaatgcgggtggtaaaatttattgtggctcaggcatagtgcataagccatcgctcaagaaagaacgacatttttctggaccacacagcctcatgtcaaatgcaattctgttttccaataatcagcatttgtaataagcatctggtgaactaaactccacctcagagcctgctttgaagagaactcaaccactcccaagtccaatctgcctctcccacagtccacctcacacactgctttctctcctgctaccccataactggagtctctcgtgtctccctacattctgatttgccatatgggaactgctgcatctgggttacaaattctcccattccttctgctgtccccaacttaaagcaagccatttccccagtcatctatgacaccttgttcataaccagctctgaattccaaagtcatgtattcagttgtaactcatgcacatcttctctctttgctcccagatattctctctcttcttttctaaatttctcttttaaaatccagtttaaatccctttagagttttcctctctaaagcatcccagagtaagctagtatctgtaccacatcagctctgaagccatataataaagtatagaaaatgaatcaatgcttacatttttcttatttttcttaaaatatgtattttattattagtttatatggctatctttattatttttaagacaggatctcactctgtcacccaggctgagtgcagtggtaccatcacagctcactgcagcctcacactctgaggctcaagcgatcttcccacttcagcctcccgagtagctgggaccacaggcatgcgccaccacgcccagctatttttttaaatttttggcagaggcaaggtctgtctatgtagccaagcctggtctcgaactcctaggctcaagtgatcctcccacctcagcctcccaaagtgctggaattacagatgcaagccactgcgcctggcttatatttttattattaaatgcaatagaaatatagataaatacgatgtgggctagggttagtgaattattagaaggcagacacaatgaaagaaatagaacttgaccagctctcgtgaaggcccttcatgtgtccatcccaatcaatttcagaacgtaaataggaagctggtagtattatggtaaatgcaaatccaactgcaaatgcatgtggacgtttcctggtgaagtgcatcagatattttggcaagtttttctaaaggccatgccctccgttctctctaaaggtgatttgaagctgacagctttcttgatacataacaatcctttctaaagttttacacgagcagacattttacatggttttcattttttccagccattattttcttagcttgaaggtgtctaagtagatgagaaacttcaaataccttatatttccacatgtttatcctaaaaaaattaatcaaagtcttattaataaaatgtattgttttagagaaatattcaactcacactgtcatactgagcattgaactggaataaacagagtggaaatagaaggacaattttctgggtactctgtgatttgggcagaatttcttcaacagaattagacttcacaagatgcatacatataacggaataaaaggttgcaagaatgctatagctatttacctttgtaaaaaatagttcgttctatttaattaacttatttatctatttaattttctttttaagagacagggtcttgctctgtcatccaggctggagtgcagtggcacaaccatagctcactgtagccttgaactcctgggctcaagcaatcctcctgcttcagccttctgagtagctggggctacaagtgtgatctagtttggatgtgtgttcctgcccaaatctcatgctgaactgtaattcccagtgttggaggtggagcctggtgggaggtgattggatcataggggtggtttctcatgaacgggttaccaccatccccttggtgctgtttgtgttatggtgagttctcacgagatctggttgtttgaaagtgtgtagcacctcccaccccgctcttgctcctgcttctgtcatttgagacgcctgcttcccctttccttccgccatgattgtaagtttcctgaggcctccccagaagcagaagccactatgctgcctgtacagcctgcagaaccgtaaaccaattaaacctcttttcttagaaattatccagtctcaggtatttctttatagcaatgtgagaatgggccaatacaaaacttgtgccaccatgcctggctatttttttaaaatttttttgtagagattaggtcttgccatgttaaccctgctggccttgaacttctggcttcgcacggttctcctgccttggcctcccagagtgctaggattacaggcatgaatcactatgcccagcatttgttctattttaaatgcagtatttgccatatacaaaatatgaagtatgtcaggcataataatataatgaactgtaaaatacctattgttcaacataataattacattagtaataatatcttgtatttatctgttttttccctgtttcatcccctattttgtttctacctggcattcaccactattctgaatttagattttatcatttccttgttttataaattgtgttactatatattctaataagtctaaactgtaagtgcgtgtgtattcatgtagatacatatatttgatcttaaattggacatacatctacactgttaataggtaatatagaatttgcttgatttgacacttaaaaaaatggtatcatagaactaccattccacccagcaatcccagtactgggtattttcccaaagggaaagaaatcatcatatcaaaaagacactgggcactcacatgtttattacagcatattcacaataggaaagatatagaatcaactttagtgtgcatcaatgcatgaatggataaagaaaatgtgatatatattttatatatatatatatgtacacacaatggaatactactcagtcaaaaaaaaagaagaaaataatttcttttacagcaacacagatggaactagacgccatctgtgtatcttgggtgaaacaacacagaaacagaaagccaaatactgcatgttttcacttataagtgggagccaaataatgtgtgcacatggacagagtgtggaataatagtcattggagacttggaagggtgggaggggagtgagggatgagaactcgcttaatgggtagaatgtaagtaattagggtgatggttacactaaaagccaatactttatcactatgcaatatgtccatgtaacaaaattttacttgtaccccttaaatttatacaaaaaaccatgctgggcttaatatctaggtgacgggttgataggtgcagcaaaccactatggcacccatttacctatgtaacaaacctgcacatccctgcacatgtaccccagaacttaaaataaaataaaatgaaataataaattatacaaaaaaccaaaacagaaaacaacaaaaatagtatcatacttcatagtagttttgtggacttcctttttcactcaattttcttttgcttacatttattcatatcgttgcatgtgtctgtatttcattctttttcttcttcttcttcttcttcttttttttttttttgggtacaaaatacccagttgagtgggtggaccacattatatttgtacattttcctgtcgatgggtatttggatcccttccaggattgactgtttaccaacagggacacaatgtagtacgtgtgtttggaggcgtgactgcaagtgtttacctacgatatccagtcaggagaggaagtgcggaagcataggcacgtggatttagctgacagatgatgcaaaaatcgttttcggctgggggcggtggttcacctgtaatcccagcactttgggaggcagaggcaggcggatgacttgaagtcaggagtcggagactagcctggccagcatggtcaaaccccgtctctactaaaaatacaaaaattagctgggtgtggtggcgcatgcttgtagtcccagctatttgggaggctgaggcaggagaatcgctcgaacccaggaggcagaggttgcagtgagctgagattgtgccactgcactccagcctgggggacagagtgagactctgtctcaaggaaaaaaaacatttccaaagaggtggtattaatttgcacaacagatagcgttatctaagcgttctctgttgatctagattctcttcaatgcttgacattttcagaatgttgaaactttcgctaattaaatggataagatatttatcacattgtggttttatcttccctgaattaacaaaatcaagcatcatttccaacgttttgaggtctcttgcgtgaaatgcctcctctttgactttctgagttttctaaggagttgtatcttttctatgtatctgaagctttgtatatgtccaggatataaatcgtttgatctcttcttttccaaagattttgcgcagtttttctcccatattggcatttccttttcattttatttatggagtctttagaaaaacaaaagttcttaagggtaagttgttagcatggcatttccttcaatggttaatatttttgtgtctttaaaaaagaatccttttggactccaagatgagagagatatttttcctatatttccttctagaggtttaactttaatccatctggaaatatgtgtatgtgtagtggagggagggttcatatggctttcattttttccatatggaaaaccaattgtcccagctctatttattgaatagttcctcatttgctcactgatctgtaatgtcacctccttcctgtattatattatagcacacgttgactctaatgcttccaacagggagtctctgtgctcctttgcttggagtctttatctgacccggggagcccgatagttggacatgtgtcagtcaagccatagtgctgagaatctaggagatcccacaaagaaccgccctcagctgaggactgatgaatgttgaagggcaagtactctcactcacctatcccacagctggaaagagtattctactctttccaaagcttgcagcactctgcatcctgatctcttcttatgagatgtcttagtccatttcaggctgttatcacagactaccatagactggatggcttgtaaacaacagacattgattctctcagggtcacggaagctagaagtctgagattaaggtgtgggcagggctgcttcctcctgaggcttccctgcttggcttgtagattgtaaacactgtcttctccctgtgtcctaatgtggttgttcctctgtgtgtgtgcagagggagaactctgaaatggtttcctcttcttataaagattaagacccctctcacgattttacctaaacccaatcatccccttaaaggctctgtcttcacataatctcacatgggggttttgggcttaaacccatgaatttggggcaaaagggcacagttcaattcatagtaattattcaaccaaagtagatgattggcttctggtgggaaagagggaataaaaatggagagagtattatattagagaaagagagatgagagcttcatgtaaaatttttgagaaataggggagcctgggaatggatgatttggagagtcgagatgatgcaatattatataatctttgtgctgagagtgcaggaccgtggctaggtggtttgaaatactcaagacgaagtttgaaattggagcttacttcagccggggtcttcaccctggttatccatggtggtcacctgcttggtaaacatcccattcaaggactttctccactctctagctcattattccactttctgttggtgcttcctggctcgccacccagataaactccttaatagaatctttgtatcaggattcagtaggttaggtgtattaaatgcattttagacttgcaattttgtttttttctttttttcttttttatttttttgagacagggtctcactctgttgcccaagctggaggacagtggtacaatcatagcttactgcagcctcaacctctggtactcaagtgatccttctgcctcagcctcccaagttggattacaggtgtgcaccaccatgcccagttaattgttttttcttttgtagagacagagtctcgatatgttgcacaggctggtctcaaacttctgggctcaagtgattctcccatttctgccttccgaagttctgggatttcaggtgtgagccactgtgtccagcctagacttacactattttcaacttataacaggtttattgggctgtagccctattgtgaaagtcgaggagcatgtgtactttgaacagccctggacacgagatacacattaaatgactgagaaactaaaaccctattttagatagcgtgtttctgttgctgtagaatgagtcacctcatctatcaagaccaagccatgaatgcacttgagttacattttttaatattttcatggactcctaaaaatctccagtgttcttagatctcaattccaagaagagccggcttgtagactcgcagctgagaggcaggctatggtgaactcagacctggagaagatggaaggagtccagggagaaatggaaaatgatgaaagctttggcaaaagggtggtaaattgttcaaagaatgtttaaagaaaaaaaaatgaacagcaacaacaactttagaaggaaatggaactgattaaaagagtcatttttattccacttctgcaccatggaatggagtcacgcataacttgcatataattgaacattaaaaaaaattctgtagctcaatcaacttctcttggcagtgagcccatagaaaactcagaagaatcttttcagaactatttatgagctgtgctacagttgatgaaggtctggttgaggatggtgacagaggagaggaacggtattggccacaggcttaaagaacagcatatccatccactaaggctgtcgtaacaaagtcccacagagctggtggctcaaacaacagacattgattctcccacagtccttgaagctggaagtccaagatcaaggtgtgggcaggggtggttcctcctgaggcctctcttctgggcttgtagatgccgtcttctccttgtgtcctcacagggtcatctctctgtgtgtgtctgtgtcctcatcttctcttcttatgagatatcttagttcatttcaggctgctacaagagactaccatagactgggtggcttataaacaacagacattgattctcccacaatccttgaagctgaacgtccaagatcaaagtgtgggcagggctggttcctcccgaggcctctccccttggcttggagaagctaccttctccctgtgtcctcacagggttgtccctctgtgtgtgtctgtgtcctcatctcctcttcttatgaggtgtcttagtccatttcaggctgctatcacagaataccatagactgggaggcttaaacaacagacatttactctcccacaatacaggaagctggacgtctgagatcaaggtgtgggcagggctggttcttcctgtggcctctctcgttggcttgtagatgtcaccttctctctgtgtcttcacatgtttgtccctctgtgtgtgtgcagggggagaactctgaaatcttttcctcttcttataaatttgccaggcgtatcagattaagacccctcccttatgattttacctaaacccaatcacctccctgaaggctctgtcttcacataatctcacgtgaggatttatggcttaaacccatgaatttggagcaaaagggcataattcagttcataataattattcaaccaaagtagctgattggcttctgatgggcaagagggaataaaatggagagattattatattagagaaagagatatgagagcttcatgtaaaatttttgagaaataggagagcctgggaatgcataatttggagagtcgagatgatgcaatatcataggttctttgtgttgagcgtgcaggacagtcgctaggtggtttgaaaactcaagaggaagtttgaaattggagcttactgtggaattcacaaagatggtagtcaaaaacatgggaaatattaatgatacagcagcatttttcccaggctgttctgcaagggactggttcttcaagatattaaaaagggctctagaaaaaaaaaggaaggcagggagcaaggaaggaaggaaataaggaaggaaggggaagggaagggagggaggtgaaggagaaaggcagaaagggagaaagaaaaaagagaaaacacaaaggaagaaagagaaagaaaggagggaaagaagaaaaaggaataaagagagggagaggaagaagaggaagaagaagaagacgaagaagaagaaaggaaggaaggaaagaaggaaaggagaaagagagataggggaaaggaataaaaaaaaggaagaagaaagaaagaaaaagaaagaagaaagaaaggaaagaagggagggaaaaagagagagggagaaagacagatagaggaaaggaagaaaaaagataggaaaaaggaagaggaaagaaagaaaaaagaagaaagaaaaagaaagaaggaaagaaaaaagaaaggaaggaaggaggaagggaggaaggaaaggaaggaaggaaggaaacaaggaaggcacaaaggaagggagagagggacaaagagagagagggagaaagagaggaaggggaaaggaagaaagaaagagaaaaaaggaagaggaaagaaaaaagagagagaaaaacaaaacagaaagagagagaaagaaaaagaaagaaagaaaaagaaagaaaggaaggaaggagaaagaaagaaaaagatattttgcgatcaaataagatcaggaaatgcatggtagctcctacatcaacttaaacacattagtaagctttgtgattatacatgggggaatgagaattgcacatactgtttctcctcttcttcactgcctcccctttttttttgcaggagcacctgatgtagttgaggcaggtgagaggcagctgccacctctgagggcagatgggggcaggagggggcagggaacggggattgaggaccggcaggcaggatgggaatgagaaaaaccagggagatgacacacctgtggggcagaacccagatcagttgggaactcgccgtggctctctccctgatcacaacgttgtcaccagaccttcgaagtccagccctggaagtgactcagggactccctcctgggatgattcccttttattcacctgggctgcagtgcaggaggctgactgggttcacccatctgccctggacaccctaggaaactcttagagtccaccattctggttcctgaccctatgttcactcatgcccatctcttggcgtctcccgggaagcttgggcaagccctgctctctgacgtctgagcccaaatctcaccctggaaccctgatctaccaaagctcccctactctatatgcccaggaaatccagggataccacagtgggaatagaagatgctcaaaatacgccacagtgcagaattccacctgctgcttgtcactttgcaaatccctgtgtgaacccaaccagatggctgatattaggttccaagtctgaagccgtatttacttgcagctactgagagcacatttgctatcagggtgtgttctcatttcctagagtgggcaacaaatgaccacaggctgggtaggttaacacaacgggaatgtactcacccagtcctagaggccaggagtctcacatcaaggtgtgcgcagggccaagctccctccagaggctctagtgggggatccttcctgcctctcccagctcctgggggctctaggcatccctgggcttgtggccgcatcactgcagtctctgcctccatctccatgtggccttctcctctgtttctgtgtctcctcttctgtctcttggaaggacacctgtcattgcatttagggcccatcctaatctaggatgatctcatctcaagatccgtctcctaattatatctgcaaaggctgtatttctaaatacaaggtcccatttacacgttcggaggcataggacatgaacacgtttggggtcgccattcaatccattacggttgtatccagttccctccagaggctctaggtgagggtccttcctccctctcccagctcctgggagctccaggcatccctgggcttgtggccacatcactccagtctctgcctccgtctcctcttctgtctcttaaaaggacacaggccattgggtttagggctcaccctactctaggacgatctcattttgagatccttaacttattacaaagaccctatttccaaataagatcccattcacagactctgggcattaggatgtggacagatctttccaggggccactatacagttgtacccagttccctctgaaagctctaggggaggctccttcctgcctctcccagctccgggggctccaggtgtccctgggcttgtggccacattgctctagtctctttctcactctccttgtggccttctcctctgagtgtctctgtgtctcttctctttatatggacactggtagatctggggtccacccagataatccactatgatttcatcccaaggtccttcgcttaatcacatctgcagataccttttttccaaataaggtgacattctgaggttctagggatttgacatagacatttctcttccgctattctatggtatggaaaagtggaaaaaagcaaatactaaaacttgttaataaggacctgtttcctctctgtgtagagcctcttctgaaactcctggtatgttcttgcatgaaaaatgcctagaccgcgatgaggactggtgtaaacggtagatatcatctctatagcaacacataaattagcattcagaaatgcagctttgcagagagaagaacctttctctgagttcctacactcaattctgtataagattcatttatttattattattttttctttttgagacagggtttagctctgccactcaggctagagtacagtggcacgatcagagctcactgcagcctcaaactcctgggctcaagtgatcctcccacctcagcgtcccaagtggctgggattacaggtgttctctgccatgtctggctacattttttatttttactagtgacgagatctcattatataatcccagcacttcgggaaactgaggcaggaggatctcttcagcccaggaattcaagaccagcgtggacaatgcagtgagacctcctctctactaaaaataatttaaaaaaattaggcaggcataatagtgcatgtccatagtcccagctactccagaggctgaaggagaatcagttgagcccaggagttccaggctgcagtgagctatgatcacaccactgcactccagcctggtgacagcaaactctgtctctaaaacaaaaaataaaataatacaattcaatgaaataaattaaaaaaacatgtggacttagagtctacttgtaatccccaccactggagaatcatttagtacagcaaagctgaaagaccaggaacggggactttccaacgtttctacaggacactctgaggcaggggggctgcgcttccttgaatgccatatctgtggataaaatcagcacattatcattagtacaggactggtctttttcttttctttacttttttttttttttctttgagactgagtcttgctctgttacccaggctggagtgcagtggctcactacaacctccaccgcctaggttcaagcgattctcctgccttagcctcctgagtagctgggattagaggcgcccaccactgtgcttggctaacttttgtatttttagtagagacagggtttcaccatgttggccaggctggtctcgaactcctaacctcaggtgatctgcctgccttggtcttctaaattactgggattacaggcgtgagccactgctcccagccagtacatgactattatttggaaaggtgcatggtagaagctgctcttggcagagaaacctgcgtaagaatcccccttgaagcttggagggatattactgggatcattgcttaagccatgggaaactggtttaaaaaatttgggagtggtttgcataatgtaaaacagggaagatgcactcagaggagaagttaaaacagccatggtaggtcagcctctgttgcagtcggggtagaaggagaacttggttgtcaaagtgtacgttgaattgagtttcggaagaacaggtcactgaaatttatcagcaaacttgatttaatggagattttcttgtgcattcgggaggtttttttccggtattccacgctgttaaaattaatgtttgagggcccagaatgagcacaagtgtttttgtaggcagaacctctgtggctccatgctgaagacatcagggtgtttacgttattatgtgggcaactaatgatggaaacagattttctactcctattttcttttactgattcatttgctaaagacatgtaatgtaagcagaattctccaaaggcatttaatcatagaagtgatggctaaaagaagccaacgattctgaaatgtcctaatgggatatttggccatttaggtgacttcactaccttcttgtgacagaatctttggacacagaacatcattctcacttcatattccatgagtacatcatcatctccacattatgctaaggcactcgttagtcacaaaatcaagaattcacttctgaaatattttaattccatgtagctctagtaaattttctttctttctttttccttttttttgagacagggtctcgccctgtcgcccaggctagagtgcagtggtgtgatctcagctcactgcagcctccgcctcccaggttcaagtgattctcgtgcctcagcctcctgagtagctagaattataggcacccgccaccacacctggctaatttttgtatttttagcagagacagcatttcatcatgttgcccaggctggcctcgacctcctgagctcaagcgatccgcccgccttggtctctgaaagttctgagattacaggtgtgagccaccttgcctggccctgaattttatttctaccatgctactccagaaatgtagacatgtcaaggatgtaaaatcatgaatagcatatgacctagcaatgaccttgtaaagtgattatatttatattacacataacatcctactaaacaattgtattacatttcaagatgtaaaaggaagaaaaataagccaatgttactcaaatatgttcaaagccacatggaaaagaaaatctgcgttatttcttctctggaagctcaaatgcctgttttctgccaaaagtgtaatttgaacagaaaaaaaaaaaaaagttggcc[141 bp omitted]tggtggcaggcgcctgtagtcaca[184 bp omitted]gaaaaaactccacacaaggtcaagaacttcttaggatccttagtgagaaagtgattctgaaatcgtttgccatggacgttcaaagacccaccgacacacaagcaaatgaggtcgtgtttggaagagacacacacgcgttgatgtaaaaatagcagaacagtacaagagcagaatgcgatgacatttaacaaagtaagaattttttttttgtaaattctagaaagtgacactctaagtcagcgtgtttcttcaactggatgatcaagttcacagcccaagaatttgcccaacttccttagatgtcctcctctctaaacgatggtaaggatgatgttatgagattcctgaaagggaagccagattgcttatcaaagacgtgtgcccactgagcctttccaagtgctttactctgagatggtccaagaggtgtttctgagaaggctatttttattgtctttggtgacacattatgtgatgcagatgtggtttccatcaatccatctagaaagtctatgcatagggttatgtctcactttccctattagtgacctggaggaagcactgcatttttgtatgcaatgatacacccatgcatgccaacttccatttatcctctttgaagatgcatgacagtacttttccttggctcttcaaaactcccaaaggggaagcaggacatgcttcctggtggtttcacttgtgttgaatctagtctcaagcctctggcatcttctgcaccccaagcctctctggacctgtgtcctggagttgctgtaggggctggacccatcatcataatgaattacaatgtggggaactcaactggacccagaaaatgtccccaaagtgcatccttatggctgagtacctccagggttcacagaaggaatgaggacaagcaaactgtgaagcaagaccctgacacaaagacacagctcaaatttagcctctgatatggtttggctgtgtctttaccaaaatcccatcttgaattgtagctcccacaattcccatgtgttgtgggagggactcagtgggaggtaattgaatcatgggggcaggtctttcccgtgctagtctcatggtagtgaataaggctcagaagatctggtagttttataaaggtgagtttccctagacaagctctcttgtctgtcaccatgtgagccatggctttcaccttctgccatgatcgtgaggcctccccagccagatggaaccatgacttctttcttttgtaaattgcccagtctcaggtatgtctttatcagcagcgtgaaaatggactaatacagcctctctggtttaccagtgaacaccggatgggaccaggattcatgttagagaatgtcccctgtatttgaatccatgtggattctctcactcttctgacccagcttggtgttttaaatttctatccttaaagtccttttcttcccacaaatgtttgctgttgcaaagttcagtttactagtgtatggggaataaaacacatggtcatgatagcctaagctgtaccatgcaacagcaatggagacggctgtcctccctcccaacagcttaatgcaaagaaacttctgctgttgtagaactctctttttttttttttttgcctgatcctttgaagtcaagagttttattgttactattatgattcctcctccagtcatctgcaatcatagcttcaagaagaaaattcttagccaacctcagagtccctttatttgcatgttgcccatggtggcaacaggggatttttggtggtcagggtacatatctgcctcaaatcctagattcatgatcacagcaccccacaggatgacacacaggttttttgtttgtttgtttgtttgtttgttttgaaacaggatcttgctctgttgcccaggctggagtgcagtggcacgttcacggctcactacagcctcgacctcccaggctcaagtgattctcccaccttagccctctaagtagccggaactacaggtacctggcaccatgtccagctaatttttgtattcttagtagagactgccttttgccatgttgcccagactggtctcaaactcctgggctcaagtgatccaccagcctcagcctcccaaagtgctgggattctaggcatgagacactgtgccccgccagacccacaggtttgatttagtttttcaagagcagtttaagaagaagcaagactttttcattttaatgttttgctatttttagcctcaagaaggctgtgttccttgcagaagtggcatatcagctcaccctgggacaagtggcatctggtgagatgataggcagctgaggttattggtgttatttgcaagggatgggtgctgatgattgccattacatcgggtttccctgatgctcagttaactctaaaggagacatggggtgagggctatgagtagggatgtggggaaaccccatggctgggatgccaagagccccacctgggcttatgtccacttcagaatgcaccatctcatggaaagcaagacatcctccacctacacttagcattttcactaccacacactgagtttcccttatctgagatgcttgggaccagaagcagtgacagatttcagatttgttcagattctggaatatttgaatatgcatgagatgtcttgggaataagacataagtataagcataaaattaatttgtgttttatatacactttatacacatagtttattgtatagcctttcatatacaatactgttatttttgttgttatcatcattatacttttagagtcagggtctcactctgtcactggagctgcagtgcagtggtgcagtcacagctgactccagcctcagtctctcgggctcaagtgatcctcacaactcagcctccccagtagctgggactacaggcacgtgccaccatgcctggctattttttttctagaaatgggctcttgctgtgttgcccaggctgatctcgaactcctaagctaaggctgtcctccgccctcagcatcccaaagtgctaggattataggcattatccactgtgcccaacctatacaatattttaaaataattttgtgcatgagacaaagtttgtttacagcgaaccaacagaaagcaaaggttgaccaggtttggtggctcacacctgtaatcccagcacttcaggaggccaaggggggtggatcatttgagcccaggggttcaagaccagcctgggcaacatggcaaaaccttgtccctacaaaaaaatgcaaaaattagccgggtgtggtggcacacacctgtagtcccagctactcaggaggctgaggtgggaggatctcttgagcccaggaggtggagattgcagtgagccatggttgcaccactgcactccagccagggtgggcaatggagtgagaccctatctgaaaaaaagtaaaaaatagatagataaataaataaataagacaggaagcaaaggtgtcagttgtcagtctctcggtcatccatgcagaaaatctgacatcatgtgagcattccaaaagttaaagattttggaacattttggattttggattttcagatgaggaatgtccaccttgtactgagaaagccttcatttattggtaggagggaggaatctagggaaatctaaggaaagtactcatgtcagaagtgtttgaaccagggcgactctatcttgaataggggctgggtaaaatgaggccaagacctactggactgcattcccaggaggtgaggcattctaagtcacagaatgggataggaggctggcacaagatacaggtcttgctggtaaaacagcatgtggtaaagaagccagccaaaagccaccaaatccaagatggcaacaaaagcaacctctggtcattctcactaatcattatactctaattataatgcattagcatactaagagacactcccaccagcaccatgacagtttacagatgctatggcaacatctggaaattaccctatatggtctcaaagggagagaaaccctcagttccgggaattgtccactcctttcccagaaaaataatgaatatttcacctcttgtttagcatataatcaagaaataactataagtatcctttgtccggcagcccaagctgctgctgtacctatggaatagctattctttacttcttttctttttcttttcttttttttttttttttgagacaatcttgctctgttgcccaggctgcagtgcagtggcgcgatctcgactcactgcaacctccacctcccaagtttgagcaattcttctgcctc[134 bp omitted]tggcctcccaaagtgccgggattacaggcgtgagccaccgtgcctggccattcctttactttcttaataaacttgctttcactttgctctgtagattcaccctgaattctttcttgcacgaggtccaagaaccctctcttgggatctggatggggaccgctttgtggtaatactcagaacagaaaatgagtaattatggggatcttacttcttaaaccaaagcaagataaggtgtgtgtaatatcacactttcctcttaaactgtgtcccacatgtgtgacaatatctaaattcttaaaataaggccctaagggttctcctcaattacctaggagttccctggaaagcagataattatgaagtgctctaaccaaataactttatagagaaggaggtttgcttatcagccattctttcgtttttccttctggagtcctgtacttacatgtacacgcatacatcagccctatatcagctctggggaatgttgtgtttggaataagccagcgagtttgttgtgttcccataatttgtccggaggtgagcaggtgactcaatctaatctatgtttaaagattgaagagaggaaacctaggattggaggatggggaaacagggggagtaaggtgcaggagattgtcatggaaaccaacaagagtcctggcctcaatccacacctctggttactaatgtggatttgaatccacttccatccatgaatatgcaaatgaaaagtttctgagacaggtttcaagcaacttagaaagtttattttgccaaggttaagcatgcgcctatgacacagcctcaggagatcctgagaatgtgcgcccaaggtggtcgggctacagcttggttttacacattttagggagacatgagaaattaatcaatacatatcagatgtccattggttcggtccagaatggcaggacaacttgaagtggggacttccaggtcataggtagatttaaagattttccgattggcaattggttgaaagaattattatcaatagaaaggaatgtctgggttatggtcaggggctgtggagacctaggttttatgatgcagaggaagtctccaggtagcaggcttcagagaataaattgtaaatgttccttattagagtctgttctttcagtaattccaaaatgggggagggtatcatgagccatgcccaacttcaccttcatggcctgaacacatttttcagattacacctgaaaaatggaacgcccttgccaagaggaagagtccattcagatgatgggggcgtggggacttagaattttattttaaggcttgtagatacaaccattctatctatgcatacaaagaggtatctatcatacaagaagaactcccaatgggcagaacatcattgtgtacacatttgactctagaattcactcttctttttgtggctaaacgggcttctcatacaatccactaggctcagaaaggttcaccaaaaaatacaatgggttcttcgtaaaaggcaagagtcaaatgctaagttgatagctgtttttaatcatacaaagagctgtgtttaaattggataatgggtgtgtaataatacattctcttctttatgacttgacatcattatgaaatatgagctctggctaaagctcaggataatgtgggagagaattaagttgagaaaaccagtttctttcataatggacaactgagaaaagttttgggatttccattacagcagattttttgaagactcacttaatgttttctgcaggatggcttagcattcctaaattcagttgagtaccaggatattataaggcttttctgtttatttttgtaacaatctgttttcggagaaccttctctgacatagacattttgcttggggccaagaatacaatgatcacatggatgacacattcactctctttatgaagtttacagacacactgcaaataatgaagtagacgaagaattaatgtcagtaagaagactgactccagagaaaagtgctgattccttaactacctaggaagaagcaaatacagattccttttgtttgaagatgtgtttatatttggagatattcaggaaaacaggaagccctcaaaatagtacattgaaagtccactaacatggaaagtctccataagccagtcaatagcatttgtaatctgcattatataatgcactgttctgctttcttaactagactttttttttgctaagtaggtttgtgtattagtcagggttcaccagtgggacaaacctaataggatctatgtgtatatgaaagggagtttatgagggagcattggctcacatgatcacaaggtgaggttccacgataggccatctgcaagttgaggaagtaggaagccagtagtggctcagtccaaatcccaaagtctcaaaagtagggaagctgacagtgcagccttcagtctgtggccgaaggcctgagaccacctggcaagccactggtgtaagtccaagggtccaaaagctgaagaacctggggcctgatgtccaagggcatccagtacgggagaaagatgaagaccagaagcctcagcaagtctgctcttttcaacttctcctgcttgcttcattttagccgtgctggcagctgattggatggtgcccacccacactgagggtgggtcttcctctcctagtccaccgactcaatgtcagtctcctctggcaacaccctcacagacacacccagaaacaatactttaccagctatctaggcgtcctgcaatccaatcaagttgacacctaatattcaccatcacagttgataagcaacctagtttatgataatctgctatagctgcctgaaaaaaaaactaagtaggtcttagaccacgactttgccccatattatcaaaattaggacaaactttttttattatatgtctgggactgacaaaacaatcactcttagacaaaaattaaattgttagctatgatgaccagtgctgagaagatcacatgatggataccctaaaagccctgacttcaccactatgcaatctatgtctgtaacaaagttgcacttgtaccccataaatggacacaaataacataattgaatttgcttttcaatgatctttaagcatcattttcactcaagttagaaaatgttttgtgtcaagtagaaataactcacaaggatttagtaaaagcgtggtagatccaggctgacatctctgcccttggcaaatagcacccaaacatcttgtctttcctaatttagaggcctctcctgtaaccttgtcaatgagtgtagtccactatcaaagccaaagtgaaacaaaaccctttgctctctgcccatgggagctaaagtgtggaattgcaacgaggtccagagagaaatgcaagaaggtctgttagattcgtgaatcaatggatgcaagtaggtcactaatcaaagcctcagttgcaaaaacgactgcttgtctagcatgacttcagctgcaataacaaactgccaaagactgggtggcttataaaccacagaaattcatttttcatggttctggaggctagaagtccaagatcgagatgccagcggctctggtgtctggtgaagaaactctgtctggtttgtcgacagctatattctcattgtgtcctcgcatggcagagggtgggaggagagaaagggagggagggaggagagagagaggaagtgagagagagagaggaagagagagaaagagagagacagagagagagaggaagagagagaaggagagtgagaaagccccagaaagggggagacacaaacactcaatcaacatcacccacatttaaggtattggacatttgggtgctgatattttgagataattttacttctattcaaaattagatctgtcttctacacagaatccatgtattctttatttttatagattaagtcctggttcttctagagaaatgacagactcggagagcaggaaatgagtgtgtttacttaacaacacttaaaagtgatcccactcactgtgaaggtcaggcagagtacagtctttttgtaaattagtattattttgtatttttaatcacagatccaggttgtgcaacttttcaacccagcagtacttttacttggcattaggaaaaggccctttgaagtttgatgacgatgattttttttttttttttaaaaaggatgttgagaggttggatggactctcatgcaccacaaatgagctttttcttctttgcagaaaagcctgttgcttgaatgggtgtctttacctaaacttaaaagcaaatgctatcaacagtttagataaaacctttttaatcatagtccaagctgagctctgctttgctgtggatttgctgtccttgtgtgtgatttgccgcacttcacactgataaccttgaactatgttctcagtttattataacaaaaaacaatcaaattatgcaaaatcttattttgtaaaacgagtttgatgattgcttaaatcttagtcatgttttaatgttagtatactcttctctcagtgaagttatgcatttttaatatctaagaatagtattatatattattctacatgtttgctacccacacattgagtaacataaagatgacttcctaccgcccctgcattttcttctgtgcttacttttttttaaaaccgttaattagaatctatgttgctaaaaaacatgttgcaacacaaaaactggcctgtgttctcatttcagcacatgcattttaaaagagatgctttcttctccattggggaagaagatatggctgacactgactctatcttctctaacgcctttctttcaccccacttctcttatctcccttcttttaacttgaaagaacaggagttgagatttctctcaacacataacattccaaaggaaataaattcttaaatggaaacttaccaaacttctcattctctatttccttccaactttttcataaacacccagatgattttttttggtataaagtcatttttcatgggaaacctggaagagttgttgaaagaatatgcagtgctattttctctgtagctctgacttagtttctgcagtacattgaggttaaaaatgatagagttctaagggaggaagctgaggaagagaatgaactgaaacctaggaattacaaccattgtgtgaagtctgttttgagatgaac[142 bp omitted]gaatccccgtctctactaaaaatacaaaaactagccaggcatggtggctcacacgtgtaatctcagctactcaagtggttgaggcaggagaaccgcttgaacccagggggcagaggctgcagtgagccgagatcacaccactgcactccaacctgggtgacagagtgagaacgtgtctcaaaaaacaaacaaacaaaaacccttaatcctcagtgcaacagtgcgggggtggggcttttgggagatgtttaagtcatgagggcttcacctttatgagcagattaataaaataaatgagaggaagtgagtttggttcccctcttgctcttctccctttcaccatgggagaatgccacaagaaggcccttgcaagatgccaacatcctgatcttcgactttcctgcttctagaactgaaggaataaatttctgttctttataaattactcaagtcttgagtattctgctatagcagcacaaaacagacctaggccccatgccctccagtgtctccatccacaaagttatttgatggaatcttcatagatcagtcttcctaaattgctgttttgctcttgccagttctcatttccaaaatgttttagcaattccccgttgactaaaggatggaattgcagatgaaaattgagaactagaagacaccatagggctatactctctacccctgcacatagaaatgaagaaagtatcctgctagtgaaaattcctatttgttggctaatatgattatatcttgaaatttcttagtggtggtggatggtgcattactccatgtcacctggccccattgactttctgtgttcttccacattttactttttttccttttaaaagtcagggtctcactctgtcacccaggctaatgtgcagtggtgcaatcatagctcactggggcctggaactcctgggctcaagcaatcctcccacatcaggctcctgagtagctgggaccacaggctgacaccattgtcctcagctaaccttttctttaattctttgtagagatggagtttcactatcttgcccaggctggtctcaaactcctgggctcaagtgatcctcctgcctcggctccccaaagttctgggattacagacatgagccactgcacctggccttgtgttctctcacattttagcaactttggctgaaggtgtaacagcaataatgttcaaaaagtaacttttattaaaaataagcattaagcatcatagcatcaatgtattctcttttaataacattgactttctcccgttaattttccctttataaaacgtacgtaagggatataaacacatttgcaaaatcaaacctattttgtatttgtatcctaccaaacacaaaataataataatgataataataatagttataaataagaaataaataaaatatttctaaatattttatttagatttagatttatttatataattattctaaataattctacaataaaattattccatagcctcatatatttcaactcaaaagtgatcttggctggtgcagtggctcacgcctctaatgccaacactttgggagactgaggtgggagaatcgcttgagtgcaggagtttgtgaccagcctaggcaacataacgagatctcatgtctacaaaaaaaggttatctcacatgccacatgcccttcagaaactgatagactatattgataatcacctctaaattaacaacataaagaaggtgaatagtacaagttttccccaattcaatcaaataataatccaaaatctgaaattctgaaagaacaaagtagtcttgggcaccaagccatgatttacaaaatactcttagatggcttgaaaaatctatggctcttcttataatactagatttcttagataggtccagtagactggtagacttttttatggttttatgcattttctctttttaaaatttttatatttaatttgagatctggggtacatgtggaggatgtacgggtttgttacataggtaaacgtgtcccatggtagtttgccacacctatcaacccatcacctaggtattgagcccggcatgcattaactatttttcttggtgctctccctccccctgctcccctgataggctccagtgtgtgttgttcccctccctgtgtccatgtgttctcattgtttctctcccacttttaagtgagaacatgctgtgtttgattttctgttcctgcattcgtttgctgaggataatggcttccagctccatccatgtccctgcaaaggacatgatctcattccttttcagggctgcatagtattccatggtttatatgtaccatgttttctttatccagtctaccattgatgggcatttggattgattctatgtctttgctattgtgaatagtgttgcaatgaacatatgcacacatgtatctttgtaatagaatgatttatacttcttttggtatatacccagtaatgagattactggatcaaatggtatttctggttccagatctttgaggaatcgccaccctgtttgtgtgcattttttactgttgcataacaaattacaaacttggtggcttgaaactatccccatttatcatcttggagtgatataggtcagatatctggacatgttctggctgggttctctactcagggtctccccaggctgaaatcaaggtgttatcagggttgcagtgtcatctgaagctgggtgccttcttctcagctccctggttgttggcagaattgagttcctagaggctgaaggagtgtgtctctaacttgtttctagctgttagccaaagccatactcagcttctacaggtagctggccctatggccctttccacaacatggcagtttttttgtctgcaaggtcatcaggggaatttcactgctactttggatgtctgacttccctgtgtctgactctaggcccagttttagatggctcatgtgattaggtcaagcttccctttcttagggtccacctatttgggacattaatgatgtctgcaaaatcccatcacagcaacacccagatatgtgtttgactgaacaatgtgcgtgcttaccagggcccaaagtcttggcagccatcttggaattctgcttcctacaattgcctattcacacaacgaaatattacacagcagtcaggaagaatggatgagagccatcagcaggctggagacccagggaagggctgatgttgcagcttgagtttgaaggcattggaggcaacagtctctcttctgcagggacctcactcttttctcctaaagctgattggatgacgccagtccctacatgaaggtctagctatggattcaggagctttgaagggctcagaaccactttctctgttggagaccatgtagaggttggacacaataatttaaacatccacagtcatctatcattttgtatcataaatacctggtctaagtacagcatttatcgagctcgtaactggtgactgtctagcccatcagttggtgtgaccacagaaaggtgctagaatctaggagtggtgacctagaaggacaatggcaaacatcacctttcttcttgggtaatttgcaacagaaactgtttattcactgctctacctccctccctaccgcttatggactgacttgtgtccctgctaaatttataagttgaagcctaaaccccaggacctcatttaaatataggtttcaagtatgactaaaatgactgcatttgaacattgggtctttcaagaggtacttaaggtaaaatgaggtcactagagtgggccctgatccaatagaactggtgtcttataagaagaggaaatgaagacacagacacacacagagggctgatcacatgaggacacagggaaaagatgagtccacaagccaaggtaagaggtttcaagagcaaccagctctgcctacaccttgatctcagatttccagcttttagaaccataaaaagacagatttctgagttttaagccaccaagtctgtgaaactttgagacaactttagcagacgaatgtactaccctcaccagcaaaagacaagtctaagttcttggccaagtatggtgttgtggttgagtcctctgggactcatgagatggtgtagcctcataagtgggactagtgtctgtataaaagggaccccagagagctccctcaccctttccaccatgtgaggtcacagcgagaagacgccgtctatgaaccaggaagtgggtccccaccagacactgaatctgccacgccttgatcttggacttcccagcttctataactgtaagcaataagtttctgtttataagcaactcagtttatgataatctgctgtagtagctgaaaaaactaagaagcaggtcttaaaccatgactgccttatattatcaaaatttgaacaaatatttcttattatatgcctgggactgacaaaacaatctccattaaacaaaaattaaattgttagctataagaccagcgctgaggacggtgagggagtgggaagacaggatgcatgggaaacaacttaatgggtgccatgtacatcactcacatgatggatgccctaaaagccctgacttcaccactatgcaatctacgcctgtaacaaaattacacttgtaccccataaatggacacaaataacataattgaatttgcttttaaatgctctttaagcatcatttttaatattgtcttcactcaagttagaaaatgtttggtgtcaagttgaaataactcacaaggatgtggtaaaagcgtggtagatccaggctggtatctctgctctgtattttgttaactatctgtctttatgaaagccatttctattggcatcaatttttttcagctgcaacatgaaggcatgcattaaataatttttgagatgcattgcaactataaatcattgataatttttgtaacaagaagattcacagctgcgacatgaaggcatgcgtttagtaacttttaagatgcattgcaactatgaatcatcgataatttccaagattcacttggaattccatttcttgcatgaacttgcatttaattccatatgttagagggagttggagggggaaaatgagattttattccagggaaggatataaagggtgttaaacattttttgctatgtaaatatacaggtcagctttgcagaaattttaaacattttgcaatgggaagcacagggtccttggcatctcaagaaaacatctgtaaacctcaataatatgggaagaatcacagggttttcaggtttgtagttttaggaggcttagaagattatgatgagaatttctttaggctccagaaaaaattgtctctcttttttcacagctgctttttggtgtttcttgaggctttattttaacaaccatgtgcacatgtgattttattataagccacatcaaatcctttgattctatgtggaggcatatggagtgtaaattatgtataaatgagcagtgagcatacatttggctatcctaggcagttttgtggtttgtggcagaaaattgctgtgtgtgagagcacctaggaggagagatgtggcgtttgatgtccagagacagataggactcagtaactactatggacagatgagaaggaaggctcattatgttttctctttgaaacagctttcttgggatataatttgcataccacacaattcacccatttatttcttatttttattttttatagatagggtcttactctgtcacccaggctggagggcagtggcgcgattatggatcactgcagcctcagcatcctgggcttaagtgatcctcccacctcagcctctcaagaaactgggactaccagcatgtgccagcatgcttgcctgattttgttgttgttggggtcttgctatgttgccccagctggccttaaactcctggactcaggtgatcctcccacctcagcctcccaaagtactgggattacaggtgtgagctaccacatccagcccagttctcccattttaagtataacacgcaatcatttttaggacattcatagttgtgcaacaatcaccacaatcaactttagaacattctcatcaattcaacaagaaattccacactttttagctatccttgcattattcctccaattacccctgatcccacatcccttggcaaccagtaatctgctttctgtctatggatttgcttattctgaacatttcctataaatggaatcataccatatgtggtccttggtgacgagtttctttcactgagcttaatgttttcaaggttcttccacattgtagcgtgtgtcaaagcttctttcttttttaaggctgattaatattctattgtgtatggctagaacacattttcatgataacattcaaagagtcagaaacaagtctacaggctttccaggccaaattctaggtgtggtttctctcggcaaagcattctccctgaacccccagagctgattgctgtatcgggccctgtcctggtaaggacagagagtgacattaactcatctctctttcttgggcctcacagtcgtctgtgtgatcgctgccagcacaatgtggaagggaagtcttggtttggctaactgcaacgtactcatggctcagattctgaccaaaagagttatttcattaaagacagacagggcaggtagaaaagcaaagcgcttgtaaacaaaccatgatgggcttctcccttccccctctttgcttccttccttccttcctttccttcctttctttcctttcctccctccctttctccttccttctttccttccttcgttcctttccttcctttcctcccttccttctttccttctttccttccttccttccttccttccttccttccttccttccttcccttcccttccttccctccctctcactctccttcctccttccttccttttctttccttctttctctttctttctttctttctttctttcttttctttctttctttctttctttctttctttctttctttctttctttctctctctttctttctttccttccttcctctttctttctttctccctcctttcttctttctttctccctcctttcttctttctttctttttttctttctttctgtcttagagacggtttcactctgttctcacccaggctggagtacagtggtgtgatcatagctcactgcagactcaaactcatgggctcaagtgtccttccacctcatcctcccaagtaactggggctacaagtgtgtgctatcatgcctggctaatatttttatttttatttttgtagagacagggtttcaatatattgctcaggctggtctcgaactcctgggctccagtgatcctcccaccttggccttccaaaatgctgggattatagctgagaaccaccttgcctagacccctgtctttctgaaggactgaacacactacttgggtcagccaaggcagagagatgtcttaaggccagtaaaacaagcaacgaagtgagccctcagaggagggggctatttcacaagaccactctcacttcggacaccagttgcaggttgagaagagttcccaaaactaccctcaagtttagtagttccctagaaggactcacagaactcactggaagatgttacactcacatttgtggtttattacagtgagaggatgacagatcacagtcagccaatggaagaggtgcatgggatagaggtccaagccaagtaccaaacagagcttctattatcctctccccttggagtcagggaagtgttggtttctaggcatcagtgtatggcaatatgcatgaagtgttgccaacttgggtgtagtagtccattcctgccttgttataaagaataaatggagtctgggtaatttataaagaaaagaggtttaattggctcacagttctgcaggctgtacaggaagcatgatgctggcatctgcttctcaggaggcctcaggaggctttcagtcacggcatagggtgaagggagagtaggtgtctcacgtggtggaagcaggaatgagagagtgaggaggggctacacacttttaaatgaccagatctcatgagggcacactcactatcacaaggacagtacgaaggggaatggtgctaaactattcatgaaaaatccacccacaggatccaatcacctcccaccaggccccactgccaaccttgggaatcacatttcagcatgagatttgaagcatatccaaaccatatcactgggcatatcacctgagccttggggttcagtgtttactgaggcttcattgtgattgattaattgtctatgtggctgatcattctccagtctcactggaagtctaccaataccatggaacctgaatcccattgttactaatggatgtggctaccctgactccaaatcacactgttagactgcccagtgtgaaccaacacccctacagaaacaaatacactcctgtctttgtttggcacacattccaaaggcttagatgtcaagttttagagtcaacgccaaacccagacctctccttgagcaaagttaaattctagccaactccaaagcccagacctctccttgagcaacgttaaactctttacctccaggtctgcagaactgaacagatgtccacatcctaatcccccatgtgggagacagaataatgcccccaaagatgcccacattctaatccccatgtggtggaaaaaataatgtccccaaagatgtctgcatcctaatccccatgtaatagaatactggccccagagatgtccacatcctaatccccatgtggtagacagaataatggccccaaaggtgtccatgtccaatgaatatgttgatttacatggtaaagcagactttgcagatgagatcaagttaaaaatcttgagatggggagattattctggattatttgggtggattcaatgtagtctcagtggttcttatagaaggaaggcagggattcagaaaaagagaaagaggagatgtgacaaagagagtggaggttggcgtgatgcaggaagaaagaaggcaccacaagccaaggaatacagcaacctctagaagctggaaaaagcaaggaaacagattcatccatggagcatccagaagaaccattcttgcagacacccttatttcagcccagtgaggctcagttaaatttctgttttggccactgaaatgaagccccttcctttataaggcaaaatacctagaccagcagccagaggagtcatggtttaaggtcctcagtggcctgcgagtgtcaatgttgctacctttggctgtacctacagccagcagctgcaacccccactcatggcataagatgccaaaaactgcaaggtcacaggaacatgcagccagcactttacgcagcctccatggggctacacaagaaaccctgatattgcaaaacagctcagagttcattgtttctcagcatccttctcagggtctcctagatgatgactttgggcatttaaggagcaatttatgtgtgcccctccccacttggttaggagcccactgcaaagtctacagggggtttggggagaaataaggacttctgtctatcactgctccagttacaatggaaagagagcctgtcacatgacccaagcaggctccccctcctcctgcacatgagcctatgctactggatggaaggaaaagaagctcaaagctgccttctcttaatatccttctctgactcaatgattcctacctggaggtggaagatgctgagaggacacacacgtttttatggagggagagaaggagagagaagaatggaggaagagagagggagagaaggaaaggaaggaagagagagaagaaagaagaaagagagagggatgaaggaagagagaggaagaaagggagagaaagaaggaaggaaggagggagggagggagggaaggaaggaaggaaggaaagagagagaaagaaagagagagaaagggaaggaagggaaggggaggagaggagaggagaggaaagaaaagaggaaaggaaaggaaaaaaatgaaaagagggaggcagagtgagacagagagtcagagagagaaagaggaagaaagagagaggaaaggagagaataagaagggggaaatggagaaatataaaaaggaccaaaaaaagaagagaggggggagggaaggagagagaaagaaggaggaggaggagagagaaagaaagaaaaacaggaagcagaggggagaaagagaaggaagtaagagaaagagagggaaagagggtgagagagatagaggaacgaatggtaaatagagagaagggagaaatggagaaagggagaagagattaagagaaagagaaggagagcagacagagagagagatgagatagtcagagagatatgaatggaggaaggaaaggagaaagagagagagaaaagaaggagaaggaggaggaggaagaggaggaggaggaaagagaaagagaaagaaaagagggggagggagaaagagaaagaaggaaagagagccagacagaaaggaacaaatggataaacagaggaaggaagggatggagaaagagaggagaaaaggagagagagggaaggaaggagggagtcagggagaaagagagacactgtgtgcttgaagaaaagttacaggactggctatcatttcctccggaggccaacaaaactctccctgctcgctaagccccactgaatatatttgaaagagctagtaagagataaaataaaattgctttgtgattatactcaatgagtcatgcttgttcgacacaccagttacatatgctttccccctaagagccctcaagaaataccagtcctatagtgtaatagagttggatctccaagagctgtttaggagcaagaactcagccgacaggatttctggagaatttctcctggcttgtctctgatcaagcaacgtcaccaagaggcgattattaaccccattgatgttggattcctcacttagagaaatgacggaatgactccttgttcatcctcagagctccttttattttcaaagttctatctcctaggtaaagattaaatttctgtattttatactaaacaactccaggctctaaccgtgttcgtctgcccatgtgttcaagatgggcacgcacatcagaatatcttgaacttgctggaagaagttaaggagcattcatggtctccatcttaggtgttttggagggtctgtagaaggttggggctattgctgctacagagaccatgactgacttcatgaggcttgttctgattgttcacaacaatggggtttggacaagaagatgaaggtgatgtgacagggttagatcctggagaaactcaactcactttggacagataatgggtgtaatgtcccctgattgtctggacttgacagcagagggcagcccacacttggactggcattattcagcacatgtgccattacatgtcattaaccttaacatgaaactttcacctctcagcccagatgtcttacccaaaactttctgggtttgtgggttgatgggatatctcttggttgactggattgttggcttggtggctgggttttgcatctctgacactgtcttcatcttttgtcctcctggcttgaattttgggatgaggtattctgcagtaggcaggcctatgcaaacctttccccaaaagtccaagaaagctgagaagtcaaagagagaggctgacacatctagtttctcagaaaaaacaaacaaacaaaaaaaaccccaaaacatttcataggtacttaaaaacagaagccatgtttgtgtcttggatggcagagagagaagatggtggatctccacaccactacccccaaataacccaggacttatataccatggagtaaggggtgtgtaggatgattgtttaagggcaggatttatggcaagaacatgctcttacacaaggaacagtagatagaatagaaatcttagaggcatgcctggaactagggtcaatcagaagtcaacatggtggattagcattcaagatggagctactttagcctccacatgaagatactttgatgatgaatgatgcacctgttctaaaacatgggtgggctgacacctcagcactggccctggttttgtctccaggactctcagcaactgcagacctcacaactataggaacaagcttcctactcaggtcctctggctctccagagcctctctgtttctgaactgtactgacaatccctgattctttacatgagttcctcaccacttgcctcatcccagccgtgagacttctggataggcacaaccacgtgattatattatcaaaggcttgccttccaactgaaataaccttataggaaattgttttgacatttcaataaaataaaccctcttgaagagaagccaacacaaataacctttgtaataaattctgctgtgctatagtaagatagtcacaggagttcacttccattcattgaaagtttaggggaaaaaagggggaaatcttacaagaatataagctcattcagttcatgcgttcctagaaggagaggttgagtttgcatagcttggctctttctcaagtccaagtctagtcaagaggcagtctttataaacaatgatagacaacttttctggggaaagatttgtttggaaagaaatggaggataattcaaaagaggtgattgaagccttagtacagtgggctttaaatgatgggttgtgtagtgtttatttcttcctgttggtggaggagagtgattaagggcttttcctaccttaaggtgatcaaagtggtattttcataagattaatctggcggcagaatgcagatagttctcagcctccccacccatccttggcgtatatagagcacctgggggcacatatgtccaagacagagacgtatacaggcaaagtaatgctttaatcttatgtctcagactaaacataactcagaggaagacaatgttgggaagagcaccaagaacttaagacatttgtgcacattccacattagccatcttttacatcacccctcggagcacgagagctctttcacttacttttggccaaattggatacagtttgccttcgtaatatgagggctatatagaggcatttcccaaaataaaagagtttatacgtttgacccatcccagattttgttcaatgctctagttcatgctttggtggtttcctcagacacagctgaatttataaacattctgagatgtcccatagatagaggattcaacctcagttcttccacctagcacacttgcttataaaatgacatgtaacctatgagttggctgaagccatgctgaaagccaatttttaggttccaaagcagagaatcttacaaggatgtgctcattttcactttgagacactgaaagagttggtgtctaggtggtctgggataataacctaagcacataatagctctaagcacgttgtcattaatccttttattggccatagacctccatgtggctagccaactgtaaagaacaccacccacctcagtggaaagcaggtgaaggggagaaatgcctcaacccactcaacattagtaatagtcagaatggaactgatagaataaaccctgggctcaccccttagaggaaaacttaagagcttatcttccttttatatttttcattctgtaatgagattgctttttgctagtctaccaatatatatgctattcatttttaatgcaagaaaaaaatatgcatacctaatacaaacacacacacatgtatgtgtatatgtgtgtgtatgtgtgcatgtattaggtaagtatgtgtgtatgcatgtgtattttttcttgcattaaaaaaaagataacagaatctttgaccacaagattttgggtaaaataccactttagtttatggaatagcaacctagtaaaagagcatgaatgttgaaagttataaagtcagaattctttgaggatcaaagactttttcagcccatcaaacatccaagagtaattcaatgtgaaaataggatttcttccccttgtgggggattcctcaatcgctgtttcttcatttaagcgacatttggacaggaataaaatgagaaagtacatgattcttccaaagtccctgaattttcaatgcgaccatattggagatgttcttttttgaacaatgttcccacaactagtaaagctttgtctaattcaagtccataagatagagactatgatacagacatttgataaatatacacctgagttggtaggttgcagaaggagctgctttgtgctttgaataactcaatttggtgatccacagtggattgggtggcttattcccagatcctcaccatcctttgtggtcagtagatatgtccaaccagttgatatggaaatggtcgtgtagatttaactgtaggaccaaggcacatgcagtggacttcttttgtcctggaagaaattagatcaatttcagcattgacaataacatctgagcttgggttgcttggctttcctggaagcatgttctttggtgtgcaaaaagagggtagatatatataattagtttgaaatttttaagggactttgatcaacccgtataagggactttgatcaacccgtatagctgcataacgtgtgtgggctttgtgaaatgtgctgagcgctaatttttaattctttcagcaacacacattcaaatgcaaacctgaatgtgtttgttgtcatgcaaaattaaaataagaaatgtagaaaattctttaaaatgaaaatgatagggactcaccttattttgttttttgtttgtgtgtttattttttgagaaagaatctcgctctgttcccctgggctggagcacagtggtgcaatctcagctcactgcagcctctgtcttccaggttcaagcgattctcctgcctcagcctcccgagtagctgagattacaggcataggccaccacactcagctaatttttgtatttttttgtagaaacagggtttcactatgttggccaacctggtctcgaactcctgaccttaagtgactctcccgcctcggcctcccaaagctctgggattacaagcgtgagtcagcgtgcccggcctttattttgtttctaagatgggaaatgaacctaagactcttgaagacatttacaacgtcaattttatcaaaacaattgagagaattcaggtcataattttgagaaacaataaaaatggtcagacaaatgctgtctatgacgagtgaaagagctctatgagttttagaacaatggtctccaaggtagggagattttgttctatgccaggggacacttggcaatgtctgtagatattcttcagtgtcacaactgagtggtctcactggcacctggtgcgtggagcccaaggatgttgctcgacaccctacagtgcacaggacacccccaccacagagaatcatccactccgaaatgtcagcagtgccagctcaactgcaaaaccctgccttagcatgagagactctgtgtgcctgtctgtcatctatttatctatctctctttttgtccacctatctgttatctgtctatcatctatatatctatccacctatcatctatttggtcatctatctgttatcattattatctatctatatatctgttgattatctatctatttatctatcaatccatctgtattagtccgttttcacactgctgataaaaacatacccaagactgggtaaattataaagaaaaagaagtttaatgaactcacagttccacgtggttggggagacctcacaatcatggaggaaggcgaaaggcatgtcttacatggcagcaggcaagagaaaggatgagaaccaagagaaaggggtttctttttattattaaaacatcagatgtcctgagacttattcactatcaggagaacaatatggggtaaactgccccccaagattcagttatctcccaccaggtccctcccacaacaggtgggaattatgggtgctaaaattcaagatgagatttgggtggggacacagccaaaccttatcaccatctatctatcgatctatctgtctatctatctattatctatctatctatctatctatcatcacaatggtttccaactgcagtccactttgccctcaggggacactggcaatgcctggagacattttctccaggtggagggttggtcctggcatctggtgggtggagcccagggacactgctcaacaccgtagagcacacaaggatgccccaccagagaatcatgcagccccaaatgtcaacagtgccaaagttgacactgctgctctgatggcactgttactctgttatagaagccatgtaggtctaaaaagatacaatgtagagagtagtggggattccagatgtgcaaatagagtaacaagtctctctggttttattttgtgtttgttttgttttgctcctgcttgggaggagggagtggaagaggggagagaagccaaataattggatgctggggatatccctaaatggtgggaccaatgacaaatcatcagtagtggcgacactaaaaagaacttaccggaaaagaatcttttatatccaatttttagccatctgtgtagattggctcttcgtgtctccctcatcctctaaaccttctcagcaaagcctgatgcatacaaagaagtcttgtgtgaattattttgtttgattattcctttacttagtcctttattcatctctggaggaaataaaagagtcgggattctgtgactgattcagcaaggggcaaaagagagacagtgtgtggatgttggacatatgatcgacagaatgaactaatgaactcaagacacgtccccttacccccatccatactttttatttactggaatcctgagaaaagcatccactgtttgtcagtcacagaattgggctttgaatggaatttatccaggacttaatatgaacacacctggaatgttcattagagcatctcttctccaaatatgacatcatgggagtgaatgaagcaaatcattttcttggctacttggcttgtaggtcatcttgtctcatacctggagaaaaatgtcagcttcactctatggtgaagtcttaggataacatctcttatgtagaagatgtgagtttgccttccagctaaaataaccttataggaaattgttttgatatttcaataaataagctctttgaataagagccaatacaaataacttttatattaaattctgctggtctatggtagaagtttaatcataggaggttacttccatacactgaatagtcagaaaaaacatcaaaaattctataagaacataataaagctcattcagctcattcatatctagaaggagagcttgaattcatgtaagttggccttttcccaggtcctaggctagtcctcaaatccagcctgcattttctttacgcccactgctactagaaaaaacatctggcagatttggaatatgaataacatcagagataaccagagaaaatctgctggccataacgagttgaggacaagctataaattgtaagtttgtgtcaattttcatttcctaaaggcagcttttataaaaggcattatttcatcccattaagagcttgggctgacatatgaatgcatcccataaattctttaccataatttgaccccattttgattatttatagccacaaacatttcttgagcagaatttcagaactttatttggaaagacaaattctgatataaattgaaattcactgaaacattcatatatatacacatacatacatacatacatacacatatatatactgtttaatatggatactctttttatatatgctgttttacctatatatataatcctacagttccatgttgtgtgtgtgtgtgtggagagagagagcatggcgcatgtatatgtgtgtgtatatatgtgtgtataaatagtacatataagtgtgtttatattgtacatatatgtttgtgtacatgtgtgtacatatagtgcatatacatatatgtatatatgatacatatgtgtatatgtgtgtcatatatagtatgtacatctatatatgtgtgttatatggtacaaatatacttgtatgtgtatgtgtgtgtgcatatatagtgcatatgtatgtgtatatgtatatataaagtaatatatgtgtgcatatatagtgcatatgtatgtgtgtatgtatatataaagtaatatatatgggtgtatgtgtgtgtgcatatgtacacagcatatgtgcatatatacacacacatagacatatgcaaacacacacatacgcccatgtatattactttatatatatacacatacatatgcatatatacacagtataactatatatatgtcatatataacagtatatacatgtctgtatatgtgtatatagcatatgtatgtatatattagtacatgtgtgtatataaagtacatatatggtacataagtgtgtgtgcttatatagactacattatatgtgtatatatgggtatgtataaagtacttgtgtatatatgtgtttatatataaagtacatatgtgtgtatagcacatatatgtatatatgcacatatagtacacatgtgtatatatcagtacatatgtgtgtatacatacaatacatatatgtgtgcatatgtatatgtgtatgtataaagtacttatatatgtgtatatgtgtgtgtatatattgtacctatgtgtgtgtatatgcctgtgtgtatacatggtacatatatgtgtatatattgatatatgtatatgtgtggggtgcatataaacaaaatatcaacagtatggaatattacggggtaatagacctgggttttggtcccatctttgattttgaggcaaattttcgtatagtccatgactaataataaaatacgcatgaaatgaaataattattttaatccagggagcaacacagtgttcagctcatcacaaacccacacattttcagagtttaggttttatcgaaggctaaagttgggatctgttcactagtgttttatctgcttccacaatgtctgatccaaacttcacatgctttcagtgactcaagacaagtaaagggacataggcctgtcggatttctgagagccgagcagcccctcagaggcacccactggaagactggatggcctgtgtctcctcagggcctgactcagcagggctgaagacacttcccctctctgatgtgtgataaatttagctaagaggttgcttcatttttgctgttcatggaagtgaaatcatgcttatttttggttccagtttcaatgaaatgtcattttcaatcaagtttctaattgaattttgtcttgtttttttgctcccccgagaaaaagaccatgaaagccagaatatatgtatgtgaaaatacatatattcaaacctaacctcaaaaaatatagtaagagctgaggtcacaaagaagagaaaaaaagtgtttctatttttcagtatttcagaatctagttggaaaaagtggtgtttatacaaccaataaggaatcaaagtctataaggtcagtaagaggggtcatgaacagacaccatgggagtggagaggagcgagagatgaattctgatttagggaaattaagagacattttaggaggagcttgtcctaattaaggctctaaagtcagataaaaaatttacataataaaaaataaaccagagactcctcaaactggaggtggcggaaacaaagagcagcacagaaaagcgagtccccgcactaagacagaagagtgaagactgggtggccagcatggtggagctgaggtgggtagggggacgatcaaattgatgagatgaatgtcgggtcagagcagctttgtgggacatcaagggaaggctcagagttagggtgtgtttctatgtgggaaggtgttgactgggtgtgctgagatgggagtttcaggtcatctccatgttgtggatgatgtaacagatgtagaggatagagacagagaaagacagagagagagaaagaaagagagaaagagaaagagagacagagagaaagatagagacgatagagacagagacagagagaaagatagagagacacagaaagacagaaagagagagagaaagactgaggacaaaagaaagactgagaaagagagaaagaaaaagagggagagcaagagaaagaaagaaagagagaagtcagaaggcatatgtgtgtgagaaagagagagacagagtcagtgccagagaaggaatgaggaaaacaaatagaaagggagaaagaaagaaaaacagaaagaaacagtgagagagagagggaaagaaaaaagagagaaaaagacagaaacagtgagtgtgtatgtgagacagagagagagagagagagagagagagagagagagaaacagagacagatggagttatagggcactggggcactagctgtctggaagctattacaagctatttattatttctttatttttccagaatgaccagcatgttattgatgagattgacattatgtaagggaattctctgtctgttcattctttttattttttttgagacagagtctcggtctgttgcccaggctggagtgcagtggtgtgatctctgttcactgcaacctctgcctcctgggttcatgccattctcctgcctcagcctcccgagtagctgggattacaggcacctgccatcacacctggctaatttttgtatttttagtagagatggggtttcaccatgttggccaggctggtctcaaactcctggccttaggcaatctgcccacctcggcctcccagagtgctgggattacaggtgtgagccaccgcactgtctgttcactcctatgtcttttactatctccttctaaaatgcaagtgtctgcaatttcctcacctttttttacacacgtaaacatcaaatttactattggaaccattttaaaatggcattaagtccatccagaaatttgtccaagcatcagcactctctagttcccgactttttcatcatctcaaatacacagctgctgtatttacaatagccagaaagtgaaaaccatccagatgtctatcagcagaggagtgaattaagaaaagatggtccatctatagaatgaaatcttattcagcctatattaggccgttctcccactgctataaagaaatatctgagactgggtaatttataaagaaaagaggttgaattggctcacggttctgcaggctgcacaggaagcatgatggcttctgcttggcttctggggaggccccaggaaaatttcaatcgtcgtaaaaggtgaaggggaagcaggaactcttgaacgtcttacacggctggggcaggagcaagagagagagcagggtagtgccacacacttttaaacaaccagatcttgtgagaactcattcactacacagtaccgagggggatagtgttagaccattcatgaaagattcactcccatgatccagccatctcccattgaggattgcaattcaacatgagatttgggtgggaacacagatccaaagcatatcacagccataaaaagaaatgcagttctcacatggctacaataaagatgagtcttgcaaatatcctgctcagtaaaagaaccgcatctcctatgacttcacttatattaaatgtcctccattattttctatgactaggctatacattgattggagcttttatacatattgatctatacgttgatagttgcggagataattgaacaaagatgcaaaaaactgtccaggtgcggtggctcacacctgtaatcccagcactttgggaggctgatgggggaagatcacttgaggtcaggagttcgagaccaacctggacaatatggtgaagccccatctctactaaaaatacaaaaattagccaggcatggtggtgcacgcctgtattcccagctacccaggagggtgaggcaggagaatcgtttgaacccgggaggtgaaatcgcaccactgcactccagcctgggtgacagagcaagactgtctcaaaataaaaggtgcaaagaaccaaggagatctccggggagtacatttcctacagggggaaatgtatgaccttccctttaatggccgaattgtcttccactttaggttgaagtcttcagagtgttcctgtttcctttcgcctttgaaatggcagtgtctgggatagatggtgtccgacttgctatgccaaatggggtaagcattatttttcaggagggtagattaggcaactctattaaagaggctgcactgcattctgtaaatggtatgaggctaagaggacatgtcctttgggcaccatccaagccggaatagaagccaattccaccatcgccttcactctggtctttctttctcctgcctattcaataatctccccaagctcttctttttcatagaactcaattattttcctttgatgaacttatacaaatttgaagtacaaattttctatggttttcttaaacaaatctctcttttgctgctctgtaaaatccataaggtctctgttgttatgaccagtgaccaggaaaattctgggcatgtgaagacctttgggtaggcatctgttgaatgggtgaattgatgaatgaatgaatgaatgaatgatgtaattaattgctaataagacccaagcacacagtatcaatcatctataaagctggcatatcaaagctttgttatatcccaaaagagttaacccagcacacaaggagggaaacacaacattttatttcattttatttcacctgtgccagttattcagataacctctaaaaactgtttaacattcacagtgtagccaaataaacagatgctggtaaacttaactccataaacggtttcactcaggagacagaggcacattgttttatcagagtttcaggatacgcgttgggaatcactgaatcctagagcggccaagggctgtgtgtctcagccctttcagatgtggggtgctctgtctctggagacccctggcttccacagtcctgggacttgtagctgactgagcctgggctgatttctctggtagttcttcctggatgtggcccaatgacccctgtatagatggattagtcagggtttgctgcagagacagaactaataggatagatatacatatgaaagggagtttattaaggagtattgacttacacaatcacaaaatgaagtcccacaacaggtcttctgcaagctgaggagcaaggaaaccagtctgagtcccaaaacctcagaagtagggaagccaacagtgcagctgtctgtctgtggccgaaggcccgagaggctctggcaaaccactggtgtaagtccaagaacttggagtctgatgttcgagggcaggaagcatccagcacaggagaaagataaaggccagaagactaagcaagtctgcttttccatcttctcctacctgctttatcctacctgtgctggcagctgatgagacagtgcccacttagactgagggtgggtctgcctctcccagttcactgactcaaatgttcacctcctttggcaacaccctcacaggcacacccaggaacagtactttgcatccttcaatcagtccagttgacactcagtgttaaccatcacagtagattttgtttgtgcccaagttcctgaaggctgtgtgtatccagacccgcacatagatcagcaggatacttgacgatctcaactggataatggaatcttttcacgcctcctccactttctttggaaacccatttttaagacacctcaaattcttctatttgaaacacttttctcaaaatcccatcaccaacagtgaaaaggattctggcaccaacaacactggaatttgaattgtttgtgctaagtggctgtctttttggaatgtcccctctctttaaccacttcccctctctgtggctttctgtctgctttcttaaaccctgggttttggaatttgatcattttgctcaggacatctgagcagttttcttctacgaagaatctgaggatgaaaggagaccacagactcctccagaagaaagaaataaggcattgcattaattcgtaaaactggtttcaaagacaaactggtatttataatcatctccggtagggttcatctcccatcccgcgtcccatataaaaattagtgagactgccaaaatccttatctttcatgttccttcttttcctgtgaaaaagacaagtgccaaatcttgttaactcagcacgatatatatgcctcttttctccctgggacttcgtgtgcctacgtcccttctgattcagggataagagattctgctttcagggtgaagtgcaactgaacgtgtttttggtgtctcgtgagcaaagccctagtgagcatgctttgtaaggtgaaatatgcctttgatatatgacagtgtttatatgtatagttaagctttttcagctttaacaagtctgagagtagtctttgagaagttttaggggttatataatgaagacaaagaagttactttatgaaagccacgtactaaaataattcatgttggtttgcatgaattatttatgtctggtgtgcattggaaatgctttctttttcagcgagaatcagttttcttagccttggctcctcagaaaagaagatcactccttatgttacagttctgtgcccattgtaaggtattgctgtggcgttttaccaactgaggagggtctcccacgtgtctgcgaagcctctgagtacttttctgtgctttttgcttcctctgtgtctacaaggcatgtgtgcaagtctccatcttgttggaagaataatccccttcctctcccatgagaggtatatggaagttactgtaggagcacacacacagagtgttgtgtttgagttttctggggctgctgtagcaaaagtgtcacagaccgggaggcttaaacaacagaaatttattctctaccatttctgggcaccagaaatctgaaatcaaggtgtctccgggtggtgctccctttggaggctctaggggagaatccttcctgcctctcccatttctgggggacttcaggcttccctgggcttgtggccgcatcactccagtcctgcctccatctccatgaggacttctcttctttatctgtgtctcgtcttctgtctcttacaggaacacctgtcattggatttaagagacccctctaaatctagccataatctcatcaatagattgtcaatttaattgcagctgcaaaagtcctatttccaaataaggtcccatccctctatacctggtgttaggatgtggacatatattttgggggccactgtgccacccactaccatatggacacttcctaactgatgtcagaatacatgcacttcccaatagttatatgctgcccggtgctttgatgaactgttgacttttggtttggagaaaacccacatgtctagagctctagctattccacagaacttaactcttactgggctctttccttttatgttcttgtaagacatgcttaaactgcttgagtgttatggttcatgtttcttttctttttcttgcagtgtaaagcctgttaattcatggccagttcaccaagaagtatcaaattcaattatatgaacactgttttttccccaaacaaatgcccttgtgttaaaaccacacacagcaatagcaatggcaactgcaacaattgcccccagctctacttaaatcacttgcatccccctattaccaatgtcaatcacctatggccactggaaggctaaggcagcgcatgcatagctattaataaaagtttttgctaaggattgacacattggtagtaccagctatgagctcacagtacaacacagttcaaacaaagaccatggatctaaatttcagagcttgaaagaagcaaatctttgcccagttaacattaggagtcttaactttttccaaggtaagaaagagagaaaaattttggctcatatggacactgttcactggatgtactatgttcagtgagcagatgtgtttgtgtatgcatgagctttggtggggttgtaatgttacttcttaataataattctgccctcatccgtttcctaggagacagaagaaaaatgaaccttacacttttgctggagcacaacatctagatttagttgccttggatgtgaaggttctatgtcctatttatccacacctctcagcggtgcccagaatgccactggcatatcatgaatacattgtcaacatctgttaagtgaatgaattggtcaatgaatgaatgcatttggcgtcatgtaaataagattcttcagggcatcagaaagctaccttatagagtaccaaattgggcatttgcttttaattcatgtcaaccaaacatttaaacatgtgctttgcccagaaatagagcatttgaaacagctaaatatatgccctttccaagtgtacttacctcagctgaggacatgttcagatgttacctttttctccttctagagttattctggcttgtcttcaggttgtgttagttgagttggtgcatttattgtctttgaataaaatgtcgtgatttatgttccctgtctgtcagccacaattctgcagcacaggagataagaagaattccccatgtgttttccatagcatttcaacttaatgcaaagttttacattagcacattcgttttcgctgtcacaaacagtcattatatgagcttttgtagcgttaatgtcattttatctcaattctgggaacatgcaaggataggaatttggtatgtcactgaaactgaatactcccaagttgccaaccagaagatttcagatctactttgttttactttgcatttacgtggctgttctccctacttttgtgtaaaattacaatgacacttgctgctttcttctaattttatggttctctatatagaagtgtagaaagttaaatggccttcagaatgaaagtctgtgttttatccctggcctaaattacggactgcatgttccaatccctggtctaagtcatggaatgcacgtgatatggtttggcagtgtccccacccaaatctcaccttgaattgtaataattatcacgtgtcaagggtggggccaggtggagataattgaatcatgggggcagtttccctcatattgttctcatagtagtgagtaagtcctaagagatctgatggctttataaatgggagctcccctgcacaagccctcttgcctgccgccatgtaagaaaaagacatggctttgctcctccttgccttctgtcatgattgtgagcctcaccagccatgtggaactgtgagtcaattaacctttttactttataaatgacctagtatcaggagtgtctttattagcagcttaagaatgaactaatacagcacatcctccccaaatccatatgtggaagccctaatccccaatgggatggtcttagtaggtggggcctgtgggaggtatgtaggtttagatgagataatgagggtggtgcctgcttgatgggattagtgtctttataagaagagaaagagactcagagctccctctctcctccatgtgaaggtacagagacatggcaccatctgcagaccaggaaggaggaaggaggccctcagtagacaccagatctgccagcatcttcatcttcccaggctccagaactttgggaagtaacatttgttgctcaagccacccagcttaaggcattttattataggatcctgaactaagacaccatgaatgtgaccttctatagcattagggtctttgtagatgtaattaagctaaaagtcttgagatgaggatgtcatcctggattatttgggcaaacctacctctaatgctataaccaaatgccataaactgggtggcttaaataaaatatgcacgaagggcaagagagacagaagaagaggaggtgatgtgagcatggaggtagatgttggagtgatgtggccacaagacagaacatcaaaaggcaccagaagccagaagcaaagaatggattcactctttgagtttccagagaaggtgtgttgctgctcacaccttcattttgggcttctggcttccagaagtttgagagaacaaattcttgctatcttaaaatttttttttttttttcatttccataggttttgggggaacaggtggtatctggttacataaattctttagtggtgatttgtgagattttggttcacccatcaccagagcaatccactgaatccaatttgtaatcttttatccctcacccccatcctgccctttccaacaagttcccaatgtccattgtatcattcttatgcctttgcatcttcatagcttagctcctacttatgaatgagaacatatgatgttcagttttccactcctgagtgacttcatttagaataatagtctccattcccacctaggttgctgcaaatgccattaatttattcatttttatggctgagtagtattccatggtgtgtgtgtgtgtgtgtgtgtgtgtgtgtgtgtgtgtacatatatatcatagttcctttaccaacctgttgattgatggcatttgggattattccacaatccacccagattatagtaatttgttacaacagccacagaaaaataacacaagaggtgtatgcatattttaggttttgtggttgtcattcattttaatgactggaacagacaattggtcaaaatcaattttagtaatgtgattgccttcctagagtgtcattgagctggatgttggagaactaattataatttctgttccacaatgactgtttttacattatgtttagccatgatttactacaggaattttattcattttatttctccatggcagcgtcacacttccctaataaatgtgacaccttttgcatggtgactatgtggtattaatgaagccagtctcctccttactcacctgatgtataaatctaatgttaatcaaatgcctgttattagcccagcattggaacagtcatcagcaatgaagcaatgagaaaacccaacgggctcctgggttgattgaggtaatctttcagtagaaataaagattgaaattacattcaattctctgtatttgtgatagttgtgttctataaagtcaccataaacactgaattagcaagttgtaaactattgctcccaggggaaatacaagattaggattctatgatgtctggtcacaacattttcatcaaccagtcaatacataatcttgttttatgcatgtttctgtttaagaaaaactttctgagtagatatttttgactcattcacactgaactcatgtccagcagcaccatgactcatgcctgagtaatgcttctctaacacagagattttctctgtgaggcacattgcagtccttttgtactagggaccccagacagcacttcagctctgttcttcaggccattttaaacagcaaaatcaccaacaaaaagcacaaacacgcaaaacacatggtactcaatggaccacaataattctacttgtttaaagtataagagctgaaacaagaaggtagggcatggccttgttccactgtagctgggaatgtgcactttgagcaatttatattttttccagctttgtgtgtgtgtctgcaaatgactgcaaaagtgctgtattgatttcgagattacaaagttttagtgagcaggcaagttcagaaagacaaaatttataaataaggaaaatcaactatacttagaaaacaaacagaatattcataaatctcaggtctgtaaacttttataattacacatggctaactctccagaccattagtcaactccatgccttcaaatttttgttgtatttggttattttctaatgagcattttggatgatagccattggactaagcattttttttttaaagcatggttttttttgagtttactccatgcacacttctctgaatagttgctacttttgtgcaaacaactgtaaaaacaaacaacaaaaataaataaaagatgagacttaagacgaattgagaaagttgcccaagcttgaaagtggttgctctggaacttgatcccaggccagacaaacacaaagatttattaacaaagttatagagaggtcaatggcctctgcttttccaagttcccttctcccctagactcagttctgctttcccttttggttctatctttttgctttccttatctcctcccatcctctctgacctcactctcattttcctccctggccccatctctatatgctgaacgcccacacattggaagtcccagctcaaaagtcattttgttcctgaaacctcaccaagttccttcaactgaattaacacctcctctcctttttctttctatatgatttattcacttttttttttctttttgagacggaatctcactctgtcgcctaggctggagtgcagtggtacaatctcagctgactgcaatctccacctcccggattcaagcggttttcctgcctcagcctcctgagtagctgggactagaggtgcgtgacaccacgcccggctaatttttgtatttttagtatagatggggttt[134 bp omitted]gttgctcaggctggagtgtagtggctggatcttggctcattgtaacctctgcctcctgggctcaagtgattctcctgctca[133 bp omitted]cagcctcccaaagtgctgggattacaggtgtgagccactgcacccagcctcactaattttttatattgttcttctgctatggtgtgaatgtttgtgttcctccaaaatttctgtgtgaaaatcttaacacccaaggtgatggtgttgggaggtggagcctttgagagataatgaggtcgtgaaggtgtagcctcatgaatgggatcagtgcccttataaaagggaccccagagagctcccttgccccttccaccgtgtgaggacacagcaagaaagcaccgtctatgaatcaggaagcaggttatcaccagattattgcatctgacacgctttgaccttggacttccagctcccagaactgtgagacataaatgcctgctgttgagaagcctcgagtctatggtgctttgttatagcagccccaatgaaagaagacaacttcccaaactccctttgtttccattacctgtgtatctttgtctacagtagcttcatttccctccacaaagtttagtccgcgcaggcagtaacagtgttgtctatatgtctatagccttgacatgcacaatgatgtgttttaagtcaatacatatgtattggattgatttaaatgtaatgtgataaagacagaaatacataagatgggctcaaaaatacttaactccaggttgcacatgtgtgaaatcatctaatacatgaggaagaagagtgtaataatgcatcctgtgaagacaccaagaaatggctgttttttacctgtgcagagaccaggaagctggcaagagttttttggcacttgtggaaagctaattgggtttgaatcctgcaggcacattttctaactgggtgaccagtggctagtaccagacacttaggctgaaaaacagagataacaatggacagttaccaatactgatggtgcagattaaatacaaatacgtagacctcaaactcccaagactcccatctacattcagagggctccacccacattggccgatgcaattgttagtaatatatccaagacttgcttgcctgggatcacatatcttaaagccttccctttgagaaagcgtgttccttcgacttaaactgctaggtaaaaagaaatgaccatggtttttaagaatggatttctggccaggcacggtggctcatgcctgtaatcccagcactttgggaggctgaggcgggtggatcacgaggtcaggagatcaagaccatcctggctaacacggtgaaaccttatctctactaaaaagacaaaaaattagccaggcatggtgg[131 bp omitted]caaaaaaaaaaaaaaaaaaaaaaaagaatggatttctgctaacgtctctttaacagaacatccatggtgacaggtaaatgggtaaatgagatcgaggtgtggccttctccttggcatggcctgtgatatcgatcagctacagtctgcatctcctctactttgatataggcacgtggttattttcttcgcttctcattgaaccagcaggagggacttgaaatcatttagccagccatcttgcaagcgactttagagtaaaatgtatgcattgacgtatgtctaccgttaccctgagaggaggaaataaccatttttttggtactgtatgttttaaaaattgtgtgaaaatacacctaacacaaaagttatcaccttcaccatttttaagtgtaccctgaagtagtgttaaatacattcacattattgtgcaaccgtcaccatccatcttcagaactcgttttcgtcttgcaaaaataaaactttctacccatatgtgccatttgttttaaaattagtgtttggtgcacccatcacccaagcagtatacactgtatccaatttgtgatctttcatccctcaccccttcccaccctttccctcagtccccaaagtccactgtatcattcttatgcctttgcatcctcatagcttagctcccacttatgactgagaacatacaatgtttggttttccattcctgagttacttcacttagaataatggtctccagttccatccaggttgctgcaaatgacattattttgttcctttttatgggtgagtagtattgctgagtagtattccatatatatctcacatttcctttatccattcattgtttgatgggtatttaggctgctttcatagtttgcaattgtaaatatacactcattttcaggtgcttaaaatcatcataaacactgaattaatgaatattgaaccctgaaactcatggccaacagtgctacaattcatgcctgaatgaagcttccctaacaaaagtattttccgtgtaaggcacatcatagctttctttcttgcacttaggaagactggacaacactcagcactatgcttggaagccattttattttcattttgtttatttatttatttttttccagagatgggttctcactctgtcacctaggctgaagtgcagtggtgtgaccatagctcactataacctcagctgactgtaacctcagcttactgggaacctcaaactcctaggttcaattgatcttcgttccttagcctcccaagtagctgagactacaggcacatgccaccacacctggcccatttttaaaaactttttgtggagataagatctcaatacatggcccaggctggtctcaaactcctggcttcaagcgatcctcctgcctcagcctcccaaagtgctggaattatagacatgagccaccgcaccgagccagggtccattttaaacagtaaaagtcacggacaaaaagcacaaaaatgcaaaaaaacatagcgctaaaaagatcatgataatggcactatctccctgtgtgcatgtgtgtgtgtgtgtgcgcgcacgcatatgtgtgtgtgttgtgcactttctgggaagaagggtctggctttcattagattctcagagaggcttatcaccttctaaaggctaggaactgctgataagccaccccccttgttttaaaggctagaaaatcaattcctgaaatctgaaataattttgcaatgtcacagacggatacaattttgcaatgtcacacagcttgggacaaagcgagggccccaggtttcctcactctattttatcagagcactgagagtggaaacctgaaatattcaagctagcattctctcttttccatgttttctaatttaccactgcatttataacgtgggaagctaacctcatatgatagaattactctccatcctcatatttttttcccaatccatataaataagaaagagtcagtataggagctaggatattgagatacggtgaacaaaaagtcactggggactgtcctataaattggaagcgtttgcagctgctggtagaacacgctttgaaaagtcaggaaagacctttttcactataaatagctccacaaagttttttcattgtcaatatgagagttttctttaaggatcttatgcagacaatggataaaaatcatactggcagacaatgacaattaagtgaaataatgtatatgaaacagcaaaggcataatagatttccattgactctccctctctctctttcactaatttccatggagtttgtcattaatcataaaatctatttgtgattagcatttttcctccttaaaccaaaattacttattgaacctgctgaatgatgttaagaacatctaaggttacatatttctttaactgagccaaaattcaccaaaaagctcaccagtttaagggtacgatttggttatgttcaagacctttgcaaggttgtacaaccatcatctctattcagttcgaaaaattttcatttgatcttagccaaaaggcctagaagcgatagatcaaaacattttcatcactccaaatggaaatctgtcaagcagttacgcttcatcctgcttccctgcagcagcccatccctgcagggaaagcaactgaaaatttgctttctgtctctgtggatttctctatctgtacatttcatataaacgaaatcatggagtatgtgaccttctgtgtctggcttctttcacctacagtataatgttttcaaggctcatctctgtcattgcatacatcattactatttatccttatagctgaataatatcccattgtatggatgtaccacattttatttatttattctcactggttgatggacattttgattgtttccacattgtagattttgtgaatcatgctgccataaacatgcatgtgcaagtatttgttgaatacttactcgttctattttcaagcctgactcatcttctgaattccagaactgtcatcccaacatgttttatatttttctttggccttcctctgcacttaaatataattcaaactccttggatatccaatgagtttctgcattttcggggcttctgcccccaaaatgcagctgctccttgtgcctgtaatgtaattggccgacaggtcaactgcttttcaaactctgggtctctgctcttgcaggttcctctcccggaaatcatttcaactggctcttgtcatgtttacctgattctcagccttcaaagatcagctcagatatcaccttcttagagacaccttcctatgggacccacgtggcaggacagtttctcttcctgattcctccatttatttattttataactcccataacatctgtgattttctacatagattctttatttactgtctgcctctcctcaaaagagtgttagcttcatgaaagcagagatgtggctttgcaccttgcctggcacatagtatatgttcaacaaatgttagtgaaataaataattctcttacggttactctaacttcaacacttccatgtctagactcgatagtttctctccaaaagtcatgtagttaataccaatgggtagaaaccaattgaactgattcctgaagaaatagagcactcgtcaattagctttggatgcatacgcttggggttttgagagatgcagatagagcatctcaacttggaccctgactcatgagggtgcttcgtgcataatttaggaggtccgaaatgatgatgaagatgaggaaggaaaaagtaaaaaaagaacaacataagaaggattgagaagctcctataattacctaacaagtctgagaagatcaaattttaatatttttcccaatgcagtatgttttccaatatgacagatacacagagcggactctgcacagtagaacaaatctttactttagcagatgtactaattggatctgtttacatgattcctcctccttcttcttcttcctcttcctcttcctcctcctcctcttcttcctcatccttcttctttcttgaagacagggtcttgctctgtcacccgggctgaagtgcagtggcgagatgatagctcactgcactgttgaccttctgaacaaaagcgatcctcccacctcagtctcccaaatagaatgtatatctttttttttcattttcataaaaaaagtagagatgaagtctcactatgttgcccaggctggtcttgaactcctgggctcaagcaatccttccacctcagcctcccaagtagctaggaccacaggcatgtgccaccacacctggataatttttttttttttgtagagatggggccttgctatgttgcccaagctggtcttgaactcctaggttcaagggatcctcccaccttggcttccaaaactattgggattacaggcatgaaccgaaccactgtgcctagccagtttgtgtgatttttatgtctgtttagcatcgcagagtcctgcaaactgcaaacagactagttctataagaacaaagtctccttgtcctcattcaaaatatcagattctatggtagcttcgggagatgtggggcctgtcgtactcacagttcccttcccaacttgtctaaaagcacagcattaaagtaacagggtctttgcatcagagcactttcctttttaggatggaaattcctctttagatgtaacagccaagttcatctctgcgcctgaactcaggctttcaggatacactgtatattttcttcttttattcattgtgatgcttttgtaccaaacagagtctgtttcatgaaaacaaatggataaattaaataatcaattgagtcgtcttattttccaccaaataaacatgtagatcgactctgcagtcgcaaatatgaccataataccttctgagcagtaaagaaagagtgcgtgagctgccccttttcaaactttttaacccccagtctctgcagtgccaacattttgcagagacaactttctttttactaggtctttcattcgtgccagtagcagtgggcttatactggaagcccagagagatcacatttgtaatagaactgtttgtgccgaaagagaaattatccttgtcacttagagcttgctagagtagcagtaaaacccccgagatgaattacagatctaataatgagcttcctcttcctgtcccagtctgtctggggaatggggggagatgacaatgtccgctgtgcctacagacatccctcgcattgataaatctgcttccccctgcagctctttccaacatagcatgtctttaatttattacccctttggcttagctcagggatcactgagttctgccagctagcatgatgttaaatccatgccaagtttatgcgtccagtatttccaggtggctttcgagaggggtcgtggagacaggcaagaaaacacacaaggcagcattgtgcaaattcagtgtcaactccttacatctgccccacatccctttctaattcaaggccactcagctgattcccgcagagactttcgttccacggtggctttccaccgtccagtggtacctctgtagctgccctgactcactgtgccatcaaaaatctccttcaatcaaaccagcctctgaatgcactcgacaaggtcctgcatgttgaagcctgcaatctgcaaatctgcaccatctttctaaagctgcctgctgcttacattttgagaggaggatgaggttaattatcggaggtggaaaataaatatcacagagcagctggacatgggggagcttgcagcgtcagcaaatcatggacactcaccctgctacccagagagaaaagggacccctggagacttgagcaaaaggttgagtatttataagaaatgcctgtgtggcactccggggcaccggtaaatatttcagaggcaggcatattttccataacggatgactgtttgggtgggcaggaagtggagttgctatgagtagtcagaataacattccaggactgtaaatgcttaatgagcgtgtgtgtgtgtgtgtgtgtgtgcgcacacaaacacacaaacacacacacacacacacagaaagcaccatcttcctcaaagagaggaagtccttcattgttgaagaaaccaaaataaaatgacttgtggttttccccatgtcctcttgcgttgtaagtaaataccttcatagagactccatttctccaaaccctatttattccccattctttgcagaaaaatgctggtacatttttaccccaggaggcacagccaccccagagccacacagcaatggatacttaagaataaggtaaggttgagtatttttacttttatttttattttttgagacagggtctccctctgttgcccaggctgaagtgcagtggtgtgatcttggctcactgcatcgatctcctgggtacaagaaatactcccacctcaggctcccaagtagctgggactacagacatgcaccacctgcctggctaatctttttgtatttttttgtagagatggggttttgccatgttacccgggctgctctcgaactcctgaactcaagcaatccactagcctcagcctcccaaagtgctgggattacaggcatgagccaccacacctggcctcttatttgtaatttttaaacgtttttttatttttatagatttaggggataccagtgcagttttgttacatggagagattgcagagtgctgaagtctgggcttttactgtaactatcactcaaatagtgtacattgtatccactgggtaatttctcatccctcaccttcctctcccctccctcctttcccagtctccaatgtctcttattccactgtctatgtccatgtctacacagtgtttagctcccacttataagtgagaacatggggtgtttgtcttcctgttttggagttgtttcacttaggataatgtcctccagttctatccatgttgctgcaaaagtcatgatttcattcttttggggggctgtgtactattccatggtgacatggtttggctgtgtccccacacaaatctcatcttgaattgcagcttccataattcccacgtgttgtgggagggacccagtgggagataactgaatcatgggagcagtctccgtcataatgttcacatggtagtgaataagtctcacgagatctgatttttttttaaattatactttaagttctagggtacatgtacacaacgtgcaggtttgatacataggtatacatgtgcaggtttgatacataggtatacatgttggtttgctgcacccatcaactcatcatttacattaggtatttctcccaatgctatccccccgccagacccccaccccctgacaggtcctggtatgtgatgttccccgccctgtgtccaagtgttctcattgttcaattcccacctatgagtgagaacatgtgctgtttggttttctgtccttgtgatagtttgctgagaatgatggtttccagcttcatccatgtccctgcaaaggacatgaactcattcttttttatggctgcatagtattccatggtgtatatgtgccacattttcttaatccagtctatcactgatggacgtctgggttggttccaagtctttgctgttgtgaatagtgccacaataaacatacttgcgcatgtgtctttatagtagcatgatttataatcctttggatatatacccagtaatgggattgctgggtcaaatggttattctagttctagatctttgaggaatcaccacactgccttccacaatggttgaactaatttacactcccaccaacagtgtaaaagcattcctatttctccacatcctctccagcatctgttgtttcctgactttttaatgattaccagtctaactggcatgagatggtatctcattgtggttttgatttgcatttctctgatgactagtgatgatgagcattttttcatgtgtctgttggctgcatagatgtcttcttttgagaagtgtctgttcatatccttcacccactttttgatggggttgtttttttctcgtaaatttgtttgagttctttgtaaattctggatattagtcagatgggtagattgcaaaaattttctcccattctgtaggttgcctgttcactctgacagtagtttcttttgccgtgccgaagctctttagtttaattagatcccatttgtctattttggcttttgttgccactgcttttggtattttagtcttgaagtccttgcccatgtctatgacctgaatggtattgcctaggttttcttctagggtttttatggttttaggtctaacatttaagtctttaatccatcttgaattaattttcatataaggtgtaaggaagggatcgaatttcagctttctacatatggctagccagttttcccagcaccatttattaaatagggaatcctttccccattgcttgtttttctcaggtttgtcaaagatcagatggttgtagatgtgtggtgttatttctggggcctctgttctgttccattggtctatatctctgttttggtaccagtaccatgctgttttggttactgtagccttgtagtatagtttgaagtcaggtagcgtgatgcctccagctttgttctttttgcttaggattgtcttagcaatgtgagctcttttttggttccatatgaactttaaagtagttttttccaattctgtgaagaaagtcattggtagcttgatggaggtggcattgaatctataaatgactttgggcactatggccattttcacgatattgattcttcctatccacgagcatggaatattcttccatttgtttgtgtcctcttatttccttgagcagtggtttgtagttctccttgaagaggtccttcacatcccttgtaagttggattcctaggcattttattctcttagtagcaattgtgaatgggagttcactcgtgatttacttctctgtttgttaaaggtgtataggaatgcttgtgatttttgcagaattgattttgtatcctgagactttgacaaaaactggaagcattccctttgaaaaccagcacaagacaaggatgccctctctcctattcaacatagtgttggaagttctggccagggcgatcaggcaagagaaagaaataaagggtattcagttaggaaatgaggaagtcaaattgtccctgtttgcagatgacatgattgtatatttagaaaaccccatcgtctcagcccaaaatctccttaaactgataagcaacttcagcaagatctgatggttttataaggggtttcaccttttgctgggttctcattctcttcttgtctgccaccatgtaagatgtgccctgctcttctgccatgattgtgaggcctccccagccacatggaactgtgagtccattaaaacctcttttataaattacccagtcttgggtttgtctttatcagcagcatgagaacagattaatacacatggtgggtatatataccacattttctttaaccattcatgtgctgatggacacttaggttgattccatatctttgctgttgtgaatagtgctacaataagcatttgagtacaggtatctttttgatagaatgatttgttttcctttgggtagatatccagtaagtgggattgctggacgagatggtagttctgatgagcagactttctaaacccaataaaaccaagtttttcccaagaaagcagtcccattgctacagatggcaggattccccccttcctgtgtacatggcccagttctggtcttctttccaaatatctgagagatggaaagcttttctctacccactcagtgatgtcgagagtcaaatccctaggtaaaatgagctgccagtgaattgtgttgatgagcattgtaggaatctgcaatggtgcagtggcattaggagcctgccaaatggggaatgagaaggtttcttcccagaagaatttccaatcacctgggtattgacaggccagagaatttagtcccatggatggtttgagttgcttcatccaaagaaatgttggagagaagttcattctcatctgttgtgtagaagatcactctccacctccaagtctctggttgtcattaaagacccatcaagtctgctgtgtgcctcagagccagattccaaaatgccctcaagctgtcttcaagctttctgcccacagctctgtagccaatttggggcacgtgtaccgtccacgcccagcaagtgaaaatgccagttaaatgggcaggcatctgaattcaataggcatgcattctctttccacagggcagataagggatgcagtggaatgaatgtctatgtccccttcccaaaatttatgtgttttggaatcccaatctttactatcatggtgctatgatctgaacgtctgtgtcttccaaatttcatgtgttgaaatgttcacctccaaggtgatggtgttaggaggtggtgcctttgggaggtaatgaggtcatgagggtggagcctcatgaatgggatgagtgcgcttataaaaagggacccagagagctcccttgccccttctaccatgtgagggcacagcaagaacatagtgtcgtctatgaaccaggatgggcatagtaccatgtatgaaccaggaagccagtcctcaccagacaccaaatctgccacaacttgatcttggacttccagcctccagaactggaaggaataaatttatgttgtttataagcaacccattttaatgtgtattcattatagcagcctgtaaggctaagacagatggtatttgaagatggggattttgaaaaacaggtcatgagaatggagccctcatgatgggattagtgcccttataattagagacacaagagagctcattccccaccctctctctctcaccaccatttgcagacacaagaaggtagccacctgcaaaccaaaaggagagtcctttccagaccctggatctgctggcacccagatcttggacttccagcctccagaaccatgagaaattgaagatcattgctttagccactcagtgtatgctgttttattatagaatcccaagtggacagaggcagggaggaatattatcctgtttctccaatggttgtcattaaagacccatcaagcctgctgtgtgcctcagagccagattccaaaatgccctcaagttgacttcaagttttctgcccacagctctgtagccaatttggggcacgtgtaccgtccacaccattccatgccctggaagttggcatggaaaacaaaaattgcataatctccctcatacgtggaatctaaaaaagtcaaactcatagaaatagagagtagaatggtgggtgccagaggatgggggcatgcagtgtatgttggtcaaagggtacaaagtttcagttagacaggaaggataagttctggtgatctattgcataacaaggtgagtgtatttgtttgttctggcattgctataaagaactatgtgagactgggtaatttataaagaaaagaggtgtaattggctcatggttctgcaggctgtacaggaggcatggctggggaggcctcaggaaacatacaatcatgacagaagatgaaggggaagcaagcatatcttaccatggtgatggaggagagaaagaaggagtgagtggggagatgccacacacttttaaaccatcagatctcatgagaactccctgactatcacaagaggagcaagaaggaagtccactcccacgatttaatcacctctcaccaggcccctcctccaacactggggattacaatttgacatgatatttgggtggagacacagagccaaaccatatcagtgactgtagttaataatatatcgtatatttttaaattgctctaaaaattgaatttcaaatgttctcaccataaagacatgacaaatatgtgaagtgatgattattttaattagcctgatttgttaatgccacaatgtataaatgtataaaaatcacgttttaacccataaatacatgtaattgttatttgtcaattaaaaataaaaataaattgaaaactaaaaatagtaaagggagttccctccatgaaggatcaatgagtacatgccatagatttaattttgacagcaagaaacaagaaggttgcaacagtccaaacattgtgtgataaatggttgctcttaaaaatatttttatagtttgcctcaataagctaagacataagttataatctattaggtaggagtatattcattcagtggcttactgttatactcataaacagcttcatcctacttacccaaggttagttttcatgaagactgatcatctgaataaatttggttgcaaatactaattattgaaattaatggatacctactgtggatgtctattgttctaagtattcaacacatattcaagtgggtttcatcaatgactaaagcaaggctctattaacctatttacaaccaagatggcagcccagtgtgagactcatgatggtggcccactgtgagacttctctccccagcctctggtaaccatcattctacactgtatctccgtgagatccacttttttgagttcccacacaggagtgagaatatgcactgtcttccagtggctggcttacttcacttaacatcatgacctccagtttcatctatgtttgaacagttttaatcaacatgaaattcacaagaaagcaaaagagtggaaacaggactgcagtcaattgccttgatcagaacctgatcaagaactagtcaccactttggaaaacaccatctatggaaatcctcctgctgctatttgagttgccaacacaacacaccagtgttggcagttctggtatctatctcaatgattacatctagagcaaacctgtgggtcttttgttccatccctaccttatcatttacctattaaaatgccatggtgttttaaaataagagttgctttcctgttacatttctgttttacattgcagttacagcctcaaatacatgttggaaaattatttgtgcaggtgtgttcattatcagtggttttcattacatttttgtaaaaggaatgctataaaacattcaccatgaaagagagtccaagtctgagaaaatgatccttggaggcattaacctatttacaaccaagatggcggcccactgtgagactcatgagactcaaagtgggctgctatcttggttgtaaataggttaatggagccttgctttagtcattgatgcaactcccttgactctgatttacaggtgtatgttgttatttgcagcttgctgaatgggaagacatacagaggtttagaaagtagtctgtggattactacctcttctttatatagttatagcttgcccaagttatattctgataccattctttcaattttcttagatcttctctttcgttctttttaaaattttattattattattattattattattattattattattattattattttagagacaggatcttgctctgttcctctggctggagagcagttgtgcaatcatggctcactacagcctcaaactcctgggctcaagtcatcctcctgcctcagcctcccaagtagctgggactagaggcacatgccatcacacctagctaaattttttagtttttttgtagacacagggttgcactatgttgcccaggctagcctcaaactcctggcctcatgcaatccttccaccttagcctcccaaagtgctaggatttataggcatgagccactgtgttcagtcttagattttcttaaagcctggaaatgtttgatatctgtgtcttatattgtaatgtttcaatttttttaagtccctgtgtggatttaatctgcaaccccaccataatatgttaaatcttcacagtgtcctcataaactggctgctcctttctgaattccacccatttagtcagctgaaacagaaagttttggtatatataaagaaaaaaaggcaggttggtccaggaatgactcacagtcttgtttgctaattaggtcatgatctgaatgagatttgatgagagagattgcagtcctaaccagtggttctcaatgtcgagggagcattagaagcttatggagggcttgtcaaaacacagaatgctaggtcccactccttctcatttggtgggtctagggaaggattctagaatttgcatttctaacaaattcccaggtgatgaggctggtccaggtaccacactttgagaaccactgggaagactgaagaaagtaacatgggagtttttctaagacattttatttgtagccaatgaagaaatcttatagccttctcccctttgaaactttgtgtgcaggcaagcaggacctgaaagacttacccaacaacagctgtcttggactatgtgttataggaccactgagtctgtatgcccactgtgcagtaacaaaccaatacactgagacagcagggtttgcagcagagaaagagcttaattattgcagcacactgagtgagaaaacactgactccactctccctgtggagtcctgagctgtagtttttaaagggattgcagaggataaggggctggaaaattggggtcattgactgctttgggtaaggaggatgaagtcatcaggatatggaaactgcattctttggtgagttagcttcttgtggtgtccttcagaccacctggcatcagtagtttcatcagtatgcaggacctgaaagaatatctcaaagggaaaacttgtttcataatgttgaagttgttatctagaaagcagttaagggaactctaatctagggtctatgtgattctaggacaagaggcacgaaacaactatgacaaagcaggacagggagcaagctgacctcaggatgagtgttgagtgtgctgtgagcttggtttattttcatttctcccctttgtttttcccctgctaaattttatgaagtttatagggatgatttcacatgtgtgttgatagttcaagatgtagctctgccctactatgaaaagtgcagaaatctttctcacaaagatcatagaatgagtaaaagtttggaaaagtagtttcaagggaagttatctttcaagaataaaactaggtggtcagcaagacaagaccatataacaggtccatataaccacatgtgggctaaggaacatgatatattacctgttcttggttcttgtatcaccaggacataatttagggaccaagctttagaaaacttagcacaaaaattcatggagggaggaagggagtaatatattaacaaattggaaataaactgaaattttatctttcagagagatgtgcagaaatgatggattccagggtagagaccagatatggccaacaatttgggagtgagcgcatgaagagaacgcattagttaattatgagaaaattgctattaattgcacacagaatgctgagctaaaatgatggtaacctgtgtttaaaatgtataaaaattagtgtgcaggcactgatttgaagcatgctaaatgaaactttccttccctacaacttggcctgagatcccaccttgcttgatttttgtttcccccctcccccgccccggattgttccaccaacattcctacaggtttcttgggagcccttcctctcagggtctacttctgaggaatcagacataaattacatggatataacaaggcttacaaataaaatgagagagaatctgagtatttttaaaaaatgtaattgtatttttagttcttttaaagaatgaaatttaaaactgatgaaaattgggttttgctttttcttttaagatggatgtattgaatacccagattcctgtttttctctgggaattttacccatgggaggcatctaatgctggccatgcaccagcaagaactgcacatttattctaattttagtccaggatctgcagaagcacaagccttgccatggtgcttcctcagaggatgtcaactgaataaacagaaaagtttgactcaacattgcacctttccactgtacaaagcatttttcactccaccgtggctccaatagcaggagaaagaactgatactcagttcaagaaccttgctctttcttttgtccagccacatggcccattgatggagggagccagacacccaaagttctgcttatacagaaggaacagacaaagaagttttagagacctaaagaggagagtcttcatacccatacttcttaggaaataattaatgtttcccctttgtctcagcaaaggagataacattatactttttttttaagaaaggaaatattttggatttaacaaaatttagtttttcatagtttagcttgatcagtgcatattttttaatagactttattttctagagcagttttaagttcatagcaaaactgaacacgaggtacagagagttccccagacctcctgtccctataaatgtatagccttcctcaacatcaatttatcaacagtggaatattattcagtgctaaaaataaatgaactattgagccatgaaaagttatgtatctttgttgtaccagtatctatatctatcttgaaacatatgaaacatatctagaaatatgttgaagttatatatataatattagaatggaatatatattggaatgaaatattttctatatatttatatataaatatataaaatatacgcatataaatatttacataaatatatatttacatataatatataaatttatataaatatcatatataacctatatttatatattttgtatatttacttactaaatatgaatatcatataaatatatatatatatatatatatataacctatatttgcctaatggaatacatgaatataggtttaaaaagtttgttatgagtatctgatatggtttgaatgtgtctcctaaaaagcatgtgttggaaacttaattcttaatacaacagtgttgggaggtggagtcttttgggaggtgtttaggtgatgagaaccctactctcatgaatggattataaaaggctttgagattgtgagtttgatctcttgttctctctcaccatgtgatgccttccccatgtgaggagacagcaagaaggccctcaccagatgcagccccttgattttggacttcccagactccagaaccatgactgaaataaatttctgttcattttcaattatccagtctgtggtattctgttatagcaacacagaacagacaaaaatgttatctcttggttgacataccccttaatcatggttctcctcttttccagccaggcaaaatgacactttcagccatgaagaaatgttccctatctttccattttctcaattcaaggacctcacttttcctgctgattattctagcagattttcaatgccctctcagcaaaagcaatacattttgtggctctatattttgcagaaatcacctcataaatttttcaatgcacaattaaacaaaaactttatttctgcattgctcaatatatatatgtatatattgagccagttaaaattgtgcagagtacattgtctggaaggccatcatgttgttgcttttcattatgactgacatgccaggaaccacaccagaaatcctaaaggtgataataattatcattcactatgcaacaaacccaaaacatcgttgagatttgttgtttacaggcaagagtgcaaaactcagcttcatctcttcctagaagtgccacataaaactagttctcttctctccctcaacttgggcttgaggccatgtagtgcatgcacacctctggggatttctgaaagactgtagacttcagtgcaaaacgcccagcccagtgcctagctcaagatactcagtcaagagttattaatattgtaagtaatgttaaggaagatatcagaaaatacacattaaaatatggttattaaggaaaattccagaatggagccactttatttgacccaacagagacatggcatgtttagaaggcttctgtttgcatgaactattgggaaagcagctacaagttgatgttagatcccggttaaatgctgaagtacatatactaattctcctgtttctgtgtcagactctctgcaggaggatcaaggagtaataaaaagagcagaatatctgcagctgccaagacctcggctctaattctagatttgcagcccatggctgcacaataggcacaagaatgaaccaacgtcaccaccaaggaaagtggcacagctgagctgcacccacgtctgactccaagggaccagctattgacagctattcaccatttggtttctgtgtgtcccagtcctcacgtggaaaatgggcaaatattatctgcttcatcggtattcctgggaacctagaggaagcactagccaatatcattcacttagcataccggagttatctttccattttcttaattcaagaaccttgctctttttgccaattatcttagtagtttttcagtgacctctcagtaaaagcaatgtattttgtagccttgtctttcacagaaatcgccttataaattgtttgatatacaattaaacaaaaactttatttctgcattgctcaaagaatatatatttcatttgttataaaatattatagcattcagctaagtctcatacatttatttatttatttttatttactttttctctccaacttctattttatgttcagagagttcatgtacaggtttgttaaatagataaattgcaagtcacgggggtttggtgtacagattatttcatcacccagataataagtgtagtatcccacaggtagttttttgatccccaccctccaccctcaagtaggcgttggtgtatattgttctcacctttgtgtccatgtgtactcaatgcttagctcccactgataagtgagaacttgtggtattttgttttctgttccgttcctctgttaattcacttagaataatggcttccagctccatccatgtagccgcaaagaacataatctcattctttttatggcttcatagtattccatggtgtatatgcaccacattttctttattcagtctgctcttaataggcatctaagttgattccttacctttgctattgtgaatagtgctgccatgaacatacacgtgcatgtgtctttatggtagaacaatgtatattccttcgagcatatactgagtaatgggattgatgggtcgaatggtagttctgtttttgttttttgagaaatctccaaactgctttccacagtagctgggctaatttacatttccactaaccgtgtataagtgttcccttttctctgcaatcttgggagcatctgttgtttttgactttttaatcatagccattctgactggtgtgagatggtatctcattgtgattttaatttgcatttctctgatgattagtaatatggagtattttttcaagtttgttggctgtgtgttatgtcttttttgtagatgtgtctgttcatatcctttgcccattttttcttttttcttttttttctttttttttcggaaacagtatcttgctctgttacccagtctggagtgcagaggcatgatattagctcactggaacctctgcctcccggattcaagcaattctcctgccttagcctcccatgtagctgggattacaggcatgtgtcaccatgcccggctaatttttgtatttttaatagagacagggtctcgccatgttggccaggctggtctcaaactgctggcctcaagtgatctgcctgcctcagcctcccaaagtgctgggattacaggcatgagccactgtgcctggctgtttgcccattttttaatgttgttgtccaacatttctttgacatcaacactgtacactgcaacaatattggtaagtgtttatatatattattttgattattttttgccttaataatgctctattatcacttccatcataggattcccttctgtctgtctgaatgttttcttatctaggcttcatctggtcctgtgttgttgcatgacttttgttaaatcttttagtatccttggtctacgtggcttccgttattacgcatcttctaataaagtgagaaaattataatgaagggtttttcaaatcttatggcagtacttcttgttctgcctgaccttcctttgtgctcccatggttacagttaccgaaaaataaaataaaaaatctgagggactgcaacggcatacaagtatataattcatctcgacctcttactttactagtgcacttactagagatttcagctccagcgtgattcattctataggcatgtggaaagagctttaaagagatgtgggagacgtgcaagcttttgtgagctccacccttaacactgaagccatgcaccaggcttgaacgagcccagcgtgctttatttatcctggcaaattaactggcagtgggcggttgttttgtgggcataaggctgcaccaagatcaattaaacctttcaactaatgagaatttccttcatctcattgaacgtataccatttgtgatgatgaaaactgaacgcattgagtctcccctctcttgcaaagcaaacgtgattttctttaacccttcctaatttttctcatgctgattttgtggctgacagcgggagaagcagagtctgagtcatgtccatggactcagcaaaagctgcaccctgaggttgtctccatctctttgtgagtctttgtcgtgaatacccgcagggagccatgatttctgggctttccttgcagtgggctgtggtgcccccaattcctgctggatgaccccatggcccatgaatcacagtggggtctcagcagtaaagtgtgcagttctgcagaccagctgggactgttcctccagcctgtggttctctaagctgatttgagtgcactttttgacaaaggcagattttcttgtttgaagctgcattgcctcagttggggctaattaaggaaggttttataggaagctaataaacctttcagcaatctgcaatcagttcacacttgggattataataattggatctcaaaacccaaataaaaattcccagtgtacttccttcaacactttgctctgtgtctccaaatcctttttgtacctggctacagtttcatttttgtcctcgtagcctaagctttcttctctttgtgtctttggcttcaaacatactaataaatattgaacagtcaaagaaactgaactttaaaataatggaaaagcaaaaacctcttaatgtgattgtttctggatctggtgatattgaatggatatctgtcttttgttatttttaattatttgcatgataccctcaattcattatctagaaaaacagtccccctttcaatctccccaccctggttgaatgagacatgttactcatagtcactcaggttcaaacatttttttgaaacttatatttccttttttacatgcagacaatcaccaaactctagagaagctcgcttatattttgcaactatttttcctaatttctgttttctctagaaccactttatatcaaactttcattaatccttgtctaaatcatgataatcacctcctaactaattttgaccaggtggtcaattaattttgcctaatggaaatcaatccaatgcaatctcctattaattttcctgaaatttctcactgatctgacaatcacagcctaactaatttttacgaggaagccaattaattttttctaatgcaaatcaacctgagtcgccatgcctcttttaatgttgtttaaattccttactgattacatactccaaagtatctcgctaaaccaaacaaaaaccccacaactgttccatattgactatccaattcactccaatatggaacatgctttaaaatgcagtacaggggctgggaacagtggctgacagctataatgccagcgctttgggaagccaaggtgggagaatctcttgaggctaggagtttgagaccagtctgggcaacatagtaaaaccctgtatctacaaaaaattttaaaagttagccaagcatggtggtgtgcacctgtagtcccaactacttgggaggctgagattggaggatcactagagccaaggaggtcaaggatgcagtgagctatgatcacgccactgaactccagcctgagtgagagcgagagtctgtctctaaaaataaataagtaaaataaaagagtaaataaaatgcagcacaagacgtccagcattttcttccaccccaaagcccatacaacccgtctttaagccaaactgaaccactcattctttcccaaaataaccctaaagaaccacatccctgggtctggcttaagctgacaattctctgctaaaggggcttgtacaaatcatagccatccttgactgacttttcttctaagacctcgtttctaactcaaatttattccctttatagttccctcatctacctctgctaatgagcgtataggaggtcatctagcctgtcaacactcactgaggcgtctgtctcatttcttccatcaaatggtgaatcatgttcaatggtaggtattcagtcaatatggaaaagtgtaaatgactgaagctaaaatgtatggaacaacactgaattatcacattcctttttgttctagctgtcatgcaaggtcaactatacttggaattctgtcgctaagaactaaagtttgagttcaattaaaaaacaactcattcataaacatgttgtcctgatatttcatcagctatcttaacagcaaatacaatagaaaaatggtgcttctattgcctaaaggtaacataaataatgcttggtaaagtaaaccctgttggcaccttgagttattgacaaactcaaagcaaaaaaggcagaagtggaggggggaaaattccaagaatctacttaaatatgtatgtagaatttgggtgggaagttagagaatatgaattactccaagtcatacttttatttcatttcttttcaaaccatgtgaaattcattaatttttttaacttgtattttaggtttgagggtacatgtgaaggtttattgcaatagtaaacttgtgtcaggggtacatgttgtgcagattatttcattactcacatattaaacccagtacccaagagttatcttttctgctcctctccctctctctctccctccctccctccctctctcatctccttcctcccaccctccccgctcaagtataccccagtgtctgttgtttccttctttgtgttcataatttcttatcatttacctcccatttataagtgagaacatgcagtatttggttttctgttcctgtgttagtttgctaaggataatggcctccagctccatccatgttcctgcaaaagacatgatctcattcttttttatggctgcatagtaagcagaaattccctttgacccagcaatcccattactgggtatatacccagaggaatataaatcattcttacataaaaacacatgcatgtgaatgttcactgcagcactatttacaatggcaaagtcatggaatcaacctaaatgcccatcaatgacagattggataaagcaaatgtggtccacatacacaatggaattcattctttttattttctggggagcagtctgccacacacagagaattatatatctgaacaccaaacggccagacttggtggtcactttatttgtgagaaagcaaacctgggaagtcttgaaatggcaaacctttcagaagagatggcagagactctcctacacattctactctcaatgctctatcttgttctttccatcccagatctccctcccatcagtcttttactactcaatcctgaggcctggacgtacccacaaaagtgagttctattgattgcgctaagctgttaaaataaaatatgctttccctgaatgtgatgcaggtaaatccagataggaaacaactgtttatgtattcatgggatagaccaagagtcttgcaaagtggcctggtcaaagtcgacacatcatttccttggggaaatcttgcatcagatttcaccacacatctgttttataaactctgacagcatctgacatttatagtactgatcataactgttttatcaattggttattgggataattattcattgaaactttgccttaattactgaaatttttattaaactcttcttaccttgtttggcatatagaatatgccccttattaaataaaggcatggatgagattatctacataataggtggtgtgctaagcaaaccatctctcaaaatacacacacacacttgttagtggtgtttgccaattcccatggtgtaaattctcccactacggttcatttcaagctacatacggttggacagatggctcacacaattcctggatgtttcatggttagctcctaaaagtcagaatgagcccattccagagcatcgctcatgcataaaggtgtgaggatgcctttgctcaatttcaacaacctttctcaaaaacagagtacacttagtaatctagacttgggaagattcttcttaaatgtgatggacattttcttttggctacggggtgcatattttcttgaacagagaagtccttttttagacaatctgataaaatcagaaccagagttctgagcattacctacaaaaggctgtcctagggacatttttcttctctaaaaatcagaaacattgccaaccacagctttggaaagtggccagtaaaataaaacaagaaaaagaagccagagatataactatgggaagagagggaaagctatattttcccacaggcaatatgaccaattaagtagctcagctgaaaatgatgcaaataaacaagaccttcccaagaaagtttagcaaaaatgttcaaggcttctacaaatatgctgaaaacctggaaatatatatgtccttgcatgagaaaacacaatgttataaataatacatactaaaaatttgattcatcttttaaaagaaatccaattaaaatctcaatgacttttggtgataaatatttagtaaatgaaatttatctaaagacaaaaattagtatgaagacatataacaatgtggaaaatataagaaagcacgggttttcatattaaaatatgttgtaagacaccctacaataaaacagagaacagaaactcacatgggtatttaatgtgagtgacatttatggtcactgaggaaataataaattacttaatacatgatgctatatggtttggctgtgtccccacccaaatctcatcttgaattgcagttcccataatctccacatatcatgggagggccccggtgggaggtaattgaatcattgggggtgatagtcttataaggagtttttacccctttgcttggctctcattctctctcctcccaccctgtgaagatgtgccttccaccatgattgtaaatttcctgaggcctccccagccatgtggaactgtgagtcaattaaacctcctttctttataaattatccagtcttgggtatttcttcatagcagcatgagaacaaactaatacatgacgttagaaaaattggtttaatattcaggtaaaacaaatttagatcttgatttcacaccatatagtcaagtgagttccaaatgctttaagtttttatatatatatatacttatatatatatacttatatatatatttatatatatacttatatatatatttttatatatatacttatatatgtatatatatacatatatatgtatatatatacgtatatatatatttttatatatatacacacatatatatacatatatatatatacttatatatattttagaggcaaggtcttgctttatcgcccatgctagagtgcagtggcacaatcataactcaatgcagcctccaacttctggactcaagcaatcctcctgcctctgtttcccaagtagcagggactacaggcatgtgccaccacacccacctaattttttaaaaaagcttttgtagagacggtttcactgtattgtccaggctggtctgaactcttggcctcaagcaatccttccaccttagcctcccaaactgctaggattacaggtgtgagccactgcacctggccaaattctaatatttaaagatgaaaaatattataaaagtatgtgagcaatatcttatgtcagaaagaagagtgacctattaaacacaaagaagagtgaataacaaaggaaaaaatgaaagatacagctacaaataatttaacactactgtaccttccaaaaatgcagttccataaacaaaatagaaagaaaaatggtaactgtgaacaaagtatttttttatatttagagcaatattaatgcctcttatgtatttgctatatttaaggctccctatgtagattaattcttactgctcagcaaaccaaggctgagcagctcagtagataaaggatgcaaaattacagccagacaggaagaataagttatagtgttctatatccttgtagggtgactatagtaacacaaatatattatatagtttccaatagctagaaagagggaactgaatgttccccacacaaagaaatgatatatgtttgagatgatgaatatgctaattaccctaatgtgatcagtattcatcatatgtatcaaaacatcactacgtaccccctaaattatcctatgtcagttaaaactttaaaaaagaaatgtaaggacaaaacaaaaaataaaattcttccaagagatggccaaattaggtagtttggcaaagaagaagggggttgggaggaggaggagtaaaaagaagagggggagaaggaaagaagaagaaaggaagaagaaggaagaagaaggaggaggaggaagaggaggaggaggccattgagacaggtgactttgcaaaaggtggggtgtgtctcagtgctggtgtgcataaaggaagttgaggcgaagtagggatgttgatggctcaactcagcatagtgattggaacttggaggtttactgctaccatttggggcaatgagaggttggagtaagatcgcatctaaagattcaatctaagatttcatcttgtaataaaagtaaggagatagagcgaagtctacagagacacaagctagaacagcagttctcaatcttggcggaacattagaatcgccagggagtttgcacaaataccaacacccaaacaaaaaataaccaagatttctttttaattactatttgtgctcctgcaagaagaggaggaggaggatgaggcaggaggaggagaatgaggagagtgaagaggaaagagaagaggagagggaggagacaggaagagcataccgctttgtggctatcaaattacaagttgttaaaatgatagtaattcttgggaagcgtagtggtaaaatgtgcactctcataggctggcatggtgacaatataaattggaaaaatctctttgaaaggcattttggaaatgttttgcaagagccttaaatatgctcatacactttactgtggccattccatatctcagaatttcagagactatggggattctttgcagaggtgggcaaagttgtgaaacagtctagatgtcccccaagacaggattaaatactgagtgacacatctatacatccctaggatgaggctgactgatgttgagctatgcaaatcaaatattggggttttgggggcggaggtgaactttaaaccacatgatctgatttataatccaaactgcaattacatagtgtgcatacacactaaccaaaatctgggcatgttcagaatatttatctttgaggaataagattgcaaataatttttatttattcattcttttctattcaaatatatattatattatatagaatatcatattctaatatatttctatgtctcgttatttataacagttacactatgaaataaaggcttttcacaaagacagaagctagttccagctatgtgtgtgaaaatgctggaaacttgtttttcctctccaaacaggggctgattctccttcctaaatgcccttaaaagagtttttttttttcaatttatattgtcactatgccagcctatgagagtgcacattttacctccacgcttcccaagaattgctgtcattttaacaactcctaatttgatagccacaaagggatatgctcttcctgtctcctccctctcctcttccctttcctcttccctcaccttctcctcctcttcttcttccttttcctccttctctccttctcctccttctttctccttctccttctcctcctattcttcctcttcctttcctcctcttcctcctcctcctcctcctactcccccttgtcctccagccacctggctccagggtggatttttgtgcctgctcttgtttcagcaaggaggacatcaagacagattatctttctctgtttgagaatgtattaaatgcagtattttctgtagaaaaatatcagtggttattttttttcctatttgtttaaatacttgcctaataaaagtctcacttttccagaatcaacaataaaaaaataaaactgcagtgggttttaatccagtcatctgaaaatcattttttatctcttcctttaagtagttacttaaaatgaacctcaacctcctaccatcatccagaaaggaagatagaaaatgtttatacacataagctatttttataatgattcaaagccaaatcttgaggaaaaactataaacttcagcccctcagccaggcccagaaaatgtatgattgcattatgttgacatatttcacaaaagcttatataacataaaataatgaaaaaagactgtgtgagccttctgtttcacatggaaactcttagatttttcgtttgcttgttttttcttattgtcttaaaattcacgttgctggacattaatgaaaaatagctttgctttttttcttccaaaagccacatgtccatatttctttttcataacagaaagttgaagctagattccactaacaatgcttcactattccccaacctctttatggcttttttaaaacataaaatatacttgtttagaaatctcttaaatgataaagagggctaagagtcttaagattgtgaatagggacttgtagaaaattgtaatgtatgctgtgattaataatccaactaaattgtatcagggacacttgcctgggctgcagacgacatttctctatcacttacttgtggggagaacttcagttggtacataatcccatgaaccctagtaccctaatctggaataaagaaataatgttcagcctacagtattgttatacactttaaatggcagtataagggaatgcttttacaaaattataattcattgtgtaaattggagttatgctattaataccattgcatcaaagaaataataatcatcatcctcaaaacaagaatagatggtatttatgtatcatttctaggggagcctttcacaaatattatttcatttaaacatggcaacattttgtggctttgtggaaatatactatgggtaaaataaacctcagtctaacagaggcataccttgataagtattgctttctgatgtcaagagcaagagtgtttctcaagaggtatgacagcagtgaggataagaagataaggtatagtatgataatagcctttgtggacacccactgaaggtgctctgaattcattcaagaactcaagttcttcccaccttgacttccccatcccctagtgccttataatccctttattgagtggggaatgagaacagagaggtagaagagcatccttgcttctttactcctgagcctagaaaagacacacaccattgatgggaattcatcacatcaccccattggcgggaatccatcacatgactccacctcagagcaagggagcatgggaaatgtagtctttgcctcgggatctacattcaataaggcaggcagtgcgtggcgcttggtggacaggtagccacttctgcctcagggcagttgcatcgccatcaatgttgcaggtcaaggaactgggcaattcaattactgggagtcagatgtaggtccaggctacattatggcagacctgcttctttaacacatgttttcttttgcactcaaaagggaggaatgtgtcaaacaaaaaataaccaagatttctttttaatttattatttgtgcttgaaaatgtcccccaaattatgttttccctcctacatgttactgtttggattatccatctctccacttggaatcccatctcttcatttctccatccgttattccataacttccaaagagaaatagaaagacttttaaaataagaatgaacaattcaggccacattaagatgtgtccaagaagttggataatattcacgagtgtgaatattatcttttacacataggaagctttttataaacagattacagacatgctcaaatgaaattctttaactgggtttaatgaatcctaaaggtgcaaggtatgctagttttatggtgtggactaaaacaggcagcagtaattacagtgtgagatttgggtaagtgttttgtgtaataaaggagttagcaggttatttttaaattgatttaatagtagtctcaaaaatgagtccctcaatcttgaatctattcatacacacatatactcatacacatacatataattttatacttatattttatatttatatatgttttatattatatactatatattctatctacttatcccagactaataattatttttaaaatggctcaaataacatatattctgaggctagtttctctttagaaggaaaaaatactatttaaaccagtgcactaaggtgccaaataattccatttggaaagaaatttgttcttttaggggagtaaactaaaatgtcaatgagactttttgactttgcaaaggttggagtgtgtcccagtgctggtgtgcacggagcagcttcaggcaaagtaaggatgttgatggctcagctcagcatagtgattggaatttgaaggtttactgctaccatttgggggaacaaaattttggagcttcaagcaagattggatttaaagttcttagaatgaaagtaaggaggtagagtgaagcctacagagacgcaagctagaacagaagttctcaatcttggctgatcattagaatcacagggagcttgcacaaataccaacacccaaaacattccctaaactaattaaatctgaattgctaacagtggggtaaggggaagagagagatgtcatcagacatcagatttattcaactcttacgatgatttcaaagtgcatcgaaaattaagaaccactgatgaggagatttatcaggatttgacatttcctttgctttaaggagtggtgatatttgaagttttattgtccccatatgccccatcctgtatgatattgcctttcattatcttctatcccatgttcatgtgacaaggttgtacagaggttaagatgatggaatgtagagcagaaacttcctaggttctgaagttctcatagaacagaagagtaacatgaatataaagcacagactttctagatttaaacttctcattaagaaggtaggaagatggaatagtaattgtaccatcttagaactgaatgaccaaaggcaagctgttcaaactcactgtgcctcaacttcctactatgtaaaatgggagcagtggtattggcaccaactttgcagggtggttgtgataatcaaataagtaatatatggaaactggccaagactgtcaagactctacatagataccaattattatcatcagtattgaatttggaagatgaaggagagaagatgaatttgagattgggacaaatttagccagtcattgaaacagaaggcttccaaggtcatacgttggcaggtagagttgatggagaattttgctggaagctggagattgaagcaagaggaggcacattgcaacccagtcgctatgagaacaattattcacctttctcccgctgaagcacctcagaataagaagtaactatgggctttccgtagtctttgggagagtaccaaaatcattctaccggcatgtttaagtgaagggcagagggaggacctgagtcatttgggtgacatatataacgaacaaaggcagtttttgagaattctagaggcagtaaaagttaggaatgtaggagaaagtggtataacagggaatattagtttttacatcaccatcatagaaaagtcaaaggccataaatgtgtgaagggataaagacaggagatagaaaatgatacacctgagagttatacacatagctgctcaccgagcctggaagaccctccccatacccagcttctgaaaaaaatatattaataaaataaactttcaaaaaaagaaaattaaccagtaccattatttttacatttatcaacaactgataattctcatctaattgttttcataatctttgtcctttgtacatacatcatttgatgcttatcttatcatgttacaattaatgtctgaatctacaacttgtgttgtaagttcactgggatacaggaatcccatgcaattcacttttcatttcactgtctgactcagtgcttttcccatgctatgtctcagtaaatgttgactgaattctgagggcacggtgagagtaagaaagacaaagaaatcttttacaaggtgtatgattttcatttctagtttaccaagcatgtttcaaaaaggcaaagctttatttccaaagggaaggttttgcaaaattttacctctgctgatgtccagtctaagcctgcatggtctgaaagtgcaacggccaaagggagagaggagtaagaggagtggccttgcagttgataaacaggatgatgatgatgatatcaatgatgatggcgatgatagtgatggttgtgatggttgtgatgatgatgatgatgatgatagtgatggtgagaaaagtctttgatagaaggtcacaaatgtttgggtgacagtaagaatccttcttgtgttaaaagatggagtaaaaaatgaaatggaagacttgaaaggtagctgaagcccttgtttactaatccaaagtgaaggagtttattatgtaaatgtgaagatccaatctgaggatttttgactgaagtagcatgactggaactctagagcagaagactagcttagtggtattgtgtgttgaatgcattaaggtgaagactttagtaggcaacatcagcaataatccaagtgagatctcaaatttggtatcagcaccagagcagtgatagaccaggaatagggagaaatagaaggataagatctatgttacaaaggtatctcaacatagcttggtgagtgattgaaaggaaagcaagagagaataagtgtcataaaacattctaggtttatgaactgaaagaggtggtggcattaacagaaatagcaaaggaggaaaagctaaatttggaagaaagatggtgtatacgtcagcttctgctgcagtaacaaatactccaattcaaaaataaatgtgtttgtgtgataggaaggctgcaggtcagttacagctcagttgggctctgctgggttcagccatgctggcttcctattttggaaccaaaataaacatttcctgctgccctcatggtggaaggcaggaggtacagggttaaggaatgtcttgagtcctccgcttggataaaatttacatcatatccacttacatttcactggtctaaacatgtcatatggtcatgagtgaatctgtataatttccttcttatctgaggaagcagctcattgggaacatgatctaatttgtcccagatggtgaatgcagtttggaacacagtggaagattctagtgaggagagagagagagagagagagaggcagcaagttgcagaaaaacaaggagaaatggaactcaggaaaaagttagaaacataagtaaaatcccttaatatacaaaagttatggttgaagctagtgagattcatgaaggaagagagaaaagactggactgaagatagaaaaagaagaaaattgggtaaataaaagttgaggaagaaaaaagacattggagtataaagaaaatcaacagtgacagttatggtgggaccctaccatagaacagatataaagagtaaaggaatatgtagaatttccacattgttctcaaaggtcccttggttgtaaaaagcttagacaatatcatggatgtttgcatcatggttctactcacttgcccacatgtgcacagaattgagctactatgaaaagctcgtatgaagatcacccttgcttttcttacatgctgtagttcattttagtgggtttcaggtgggaagggagagataataagggcaggaatcatttcctatccttatggcattctacaaccatcacaaaaacctagtgtgggtttcaggtgggaagggagagataataagggcaggaatcatttcctatccttatggcattctacaagcatcacaaaaacctaaaaaattgtatccctgaagatacccagcagataagcataacattgggttaaatggcagtggatgccttcctggaatcaaagaaaagatgatagtgggaaaggagcatccttatttttgagaacccatgatgtggcagacgtgagataagagttttgtaccccaatctaaggatttccagttttaccagccttccagggactatccttaattaaatgatggcatatattgagtcaagttgagtgtcaagcagatttgcgtctttcccagtacttcaaatagtccacaggcactgtttaccttcttcttctggattttgataatctctcagatctttatattacgtttattcaggttgttgtttttccctctcaaagtcttcatcaacagaagagaaagcagccatctttcttcatgtcccaacacaccaccaacccaaggttgctttgtgtcacagaactttaccaaagttatgcaaatattggagaatgaaaattgtgcataagtgggaacaaattaagaaggaattataacagtccacgtgatccttattactgccataaatctcagaattcaaggctttccccagaggaagacaaaataaagtcaacttcataatcatctcccagccaaagagaaaattcaaatacctttattatagccactcaagacattttttagtacctacaatgttccaggcactggccaggtcaatgtgcacacatcactgaagaaactagacaaatgtcttcaactaggcattgtgagtagtggttctcttctacaccagctttcctgtcacccatttccctggtctacttcctgtatatcttcagctctgcatggcaaggaggacatccccaacagagcttctattagctggcttgttactgaagtcagcaatgggacaggttagcaggagtttggaggagaagtgggaggaatggaaggtgggtgcatctcctctgtttcagccttgggcagcaacgttgcagccacaactgatatatcttcactctgcaactcactctctggggtgcctactgctctagttgggctcctcagcccttcctttccctctgcagacaacaccatatggtaattccccttgactgaaaatactctgactatttagcccctgaagttttttctatttacctaattagaaagcatcatagagtgttagctaaatcaaaaaaggtgcgtttttctttcaggtaatttatgctaccctaccagggagtggacacagcttcagtgtttttcttctttttttttaatggaactttcaagttttgtcccaccagctatatgcagtggttttcccaatgacccagtaaagtgagtggtgtcatccccatttgacacacacaaagaaacagaagtttaagtagatgacatctacactaccacagctattacagaacaggacctaaattcaagcttgtgtctcattcacttgaaatcttatttggtcagccatgttttcccaaagctccctatccacccaaagccttgtttgattggccatgttttcccaaggctcttcattcactcaaagctttgtttcagggaccgtgtttttccaaggctcctaatccactcaaagctttgtttgattggccatgttttcccaaggcttttcatcctctcaaagccttgtttgattaaccatgttttcccaaggctcccatccacccaaagccttgtttgatcagctatgttttcccaagactttccatccacccaaagccttgttgatcggccatgcttttccaaggctcctcatccactcaaagccttgtttagttggccatgttttcccaagtgtcccatccactcaaaaccttgtttgatcggccatgttttcccaaagctccgtggttaggcacaacacagcacagcacacacgttggttctagttttggtttctagttttggttctgctacatggcttaggatgcataagctgcagctgaagttggatggtgtaggattggacctataccagtgctcctatcctacactattacagtggtcatatctaagcatgcttcttcagaattcaactctcccaagagtgcttgtgatgcttaacttgaacgcactttggaaaccattgctcttcaaagtactggagaaatgacagcaataaatatgaaaataaccaacatatactgagtacttgtgattggacaggatttgttctaagaatctcatcttctattttcacaatgaccttatgaggtaagtgtcctataagtttcctcttttccacaaatttgaaaacagaagcatgcagaatttcaacaccacaccaaggttctaatgtcttcatggggggaggcaccacacaatgtggcacaaattagcacaataggttgccccatagagggttaaattataagaaatatgtgatggatcacagtatagttttgccagaccacttcaggaacaaatgagttccagtgctaaagatgccacttcctcatcacattcttgctgcactttgtactcacccaggcttctcactgagagattctgatttgtaggtcagagtctggtgtaacaggtggaatggtggcccccaaagacatgtctatgtcataacctctggaacttataaatgtgaacttatttagataagatataactgacttaagtatctcaaaatgagatcatcctggattagatgagccctaaatctatggacacatgtccttataagagacagaggactgggaggctgaggcaggagaatcgcctgaacctgggaggtggaggttgtagtgaacagaaattgcgccactgcactgcagcctgggcaaccagagcgaaactccgtctcaaaaaaaaaaaaaaaaaaaaaagagagagagagagagacagaagaagagacatagaggagaaggccacatggagatggaggcagagactggagtgatgtggctacaagcccaaggatgcttggagcccacaggagctgggagaggcaggaaggatcctcccttaaagcctccagaaggaactggatacaaatggattgaaccatagtctcccaaaaagatatgtccacatcctaaccccagaacctgtcaatggaaccttatttggaaataaaggctttgcaggtatacttaaatcaaggatctcaagaagagatcatcctggattagtgtggccctagatcaaatgacaggtgtccttctaagatacagaacaggagacacggagaggagtaggccacacggagatggaggcagacagtgaattgatgcggcctcaagcctagggattcctggagcctccaggagctgggagaggcaggaaggatcctcccctagaaccttcagaaggagtgcagctctgcccacactttgacctcagactgctggtctccagaactgtgagataatcaattcctgttgttttaagccaccagttctgtggtcatttgcaatctcagtcccaggaaatgaagacacttggacatgaggatgtttaaatcaatccaggagatgataacataaagccaacaagagccaaaggtttcttgtgttctaacaaggttagaacacacacacaaaaaatgctgctaaaaaggaagctgaacagcctctcaggatgaaggtaaaccaacgtttgtttttttttccaaaacagagtcagtttgtgctggccatccaggaactcactaacactactcctcttagtttcatcattaatctgttactgaacttccacctccaaaagacttggatccttttcttatttttggagaccgtcttgctctgtcacccaggctggagtgcagtggtgcgatcttggcttactacagcctcaacctctcaggctcaagtgattctcctacctcagtctccagagtagttgggactacaggtgtgcaccaccatgcccagctaatttctgtattctctgtagagatgggatcttgctatttttcccaggctggtcttgaactcctggactcaagcgatctgcaggccttggtctcccaaggttctgggattacaggtgagacttgagtcttaaatgacaaaagtgcagaaaaggatcttgtggggttcagtgtcttgcagattgaattcagcagcagggttggggtcttcctcaccttgtcccacattcagccaagcttcattgaaacaagagctgcctttacaattacaaaccagacttcaaggactagagcctggttgaagttttgtttttctgtgagggcctgagagtaattaaatggtgacaatggactgttagctagggattttgcttgtgtccacagatttacaagcacatataccagatgttagaacttatccatttagggagaaaaacaacaactatcttctagttattatagtatttacaaataatgatacagccatatgtgattctgtttaatgatccgctcaaatcacacaccttcgtgttctggacaaactggtttaaatggctcttattttacctaagtcatgaggtgctaagtacctctcattataaccatccctacaagaaaattttaaatatttgcatttatttcttagggcgtctgtaaccaatcacctcaaaataggggcttaaaagaaatgaactctctcccagctctggagaccagaagtctgagatcaaggtgtctcagggccatgctccctctggaggctctagaggaggctccttcctgcctctcccagctcctggtggctccaggcatccctgggcatcactgtagtctctgcctccatctccacgtggccttctcctgtgtctgtgcctcctcttttgtctcttaaacagacacctgtcattggatttaaggcccatctaatccaggatgatctcatctcaagagctttaccttaattacacctgcaaagaccctatttcccaaataaggtcccatttcccagttctgggagtcagaatatgggcatatattttgggggccactgctcaatacactacaattgtatgcagttccctctggatgttctaggggaggatccttcctgcctcttccagctcctggggactccaagaatccctgggcttgtggccatgttactccagtctctgcctctgtctccacgtgacctccccctctgtgtctgtgtccccttatctgtctcttatagtgacacttattgcatttaggacccatccttatccagaataatctcatttccagatccttcacgtgatcacatctgcagactctttttccaaataaggttgcactgacaggttccaggtagagatgattcttttgcagaatgttatccaaccaattacaatatcctaccacgttcaaccccaaatgaaacacattttagactctagtccaaatatgtctattatttttaaaaaattattactttttaatgttcagaaacagggtctctttatcacccaggctgtagtgcagtggtgtgatcatagctcacagcagcctcaaactcttgggctcaagtgatcctcctacctcagcctcttgagtagctgtgactatgggcctgcaccactattacgttttatctatcactagatccaaggtctccttgcttgaggctcaaactttcttcatgatgtttttgccgccgggagaacacgtcctcccatttgtccatatcattctgcccagccattcttctattcttgactccgtaaaaatgttatctcagtcatcaaaatgtagctctttcttaatgggactacaatcccacctggttttttaatcctctagaatctgaatgccctctgaaccacttttaatgttttcaaacgcctcttcagcccatcacgtcatgtgaacgcagaagtttgtgttgagaggatgttaccatttttttccaggtaaaattgcaccaaggtatgtcctgcagaaacattatctacacctaggagaatttacctccccagatctcagtttccacatcatgcgctgaagcaggctgtccaaatgaacgtgtttctaaaaccctttgctgcatgtatttatctagcacggtgttttccaaccagggacggtacagcctcatggggagaatgtggctatgtctagagacatttttgattatcacactggggtggtggatgctcctggcatctggtgggtggagcccagggatgctgctcaacaccctacagtgcacaggacggtcccaccacagagaattctccagccccagatgtccatagtgctgaggctgagaaatcctcagcatgagaaactctattacccatccagtcatccatcatctatctatctatctatcatctatctatctatctatctatctatctatctatctatctatctatctatcatctatatctatctatctatctatcatctatctatatctatctatcatctatctatcatctatctatctatgtatctatctatctatctatctatctatcatctatctatatctatgtatctatctatgtatctatctatctatgtatctatctatgtatctatgtatctatgtatctatctatctatctatctatctatctatctatctatctatctatctattatccatccatctatcacccatccaaccagccatcatctatttttctatctacccctctgtcatctacccaattacctatctaattcacccaatcatctatcatcagtctacgtatctatccatctattgatcatccattcaaccatttattatctgtcatctatctataattcatccaaacatccatcatctatttatctatatacctatgtatcatccacccaactatccatcctttatctatctgtgtatctatcatccatccaaccatccatcatttatctatctatcatccatccaaccatctattatctatctacctatcttactcctttccatatctattatctatttatatctataaatcatctatctgtatcaatccttatctatttatgtctcctatccatatctattatcaacctatcatctatcactttatatctatcaatcatttatctatctgtcatctatctaccatctatctatcacttatctatctatatcaatcatctgtcagttatctatctaccaatctaatttatcgtttatgtcagtggctctcagctaggagcaagtttgcaccccctaaaggggcatttggcaatgtccagagacatttttggtcatcacaattttgagggggtgggagggtactagtatctggcgggtagagcccagggatgctactcaacaccctacacaggacaccccagcccagagaatcatccagccccaaatgtcattcatgtgcattttgagagaccctgcaccatctgaagagcctgtctattgaggataaacactccaagcaccacctcctcctccacctctttgcctccacaggcctctcttgatatccagcacacagtaagggctgtgcagacatatttaagcaaataagtggattcatgaatgagagacaggctctatgcctcccacagagttaaaaaaaaaactgcattctttagtttcaatgaccaacattctttaacaattggcgacagtgcatttcttgaaatgctgacagtcatatttttcccaaatgtttatcttgtttgcctttttccttcctctcaggggaagcaaaagaaggacagttttgcatatttgtggaacaccagtacatgtatttccagatgtcactttgacaaaaattaaaaaagaaaaatcctgaaggatttcctagagcactgcttctcagtccccacactgtcttgctgcatactgaaattgtcactacatgcaagtgacactcaaaccctgcctgccaaatctgtcatcagaagcattgcctttgactcagtttccttgcctgttaaaaatgtgtagagaagctaatcattgagagaaagtgaatgaaagcagttttttcaactgctctgatggaaacccagattcatgagaccctcttttgtccttgaaaatagcattgtcatcactgcccggtttttgggagaatattattttattatcaaatgtacagtatattgaccttaaaaatacagtaaagcagtcatggaaataacaggtcgtgtattattcatgggcacaaactgactcatggctggggaagaagcagccaccttagaccagatggacaagccagatactgcagagaagtttctgggcttttcggggaagactctagattcaattctgtaaagttatgatgcagttttctccttcctctcctctcacctcctctgagcacagctttcaacaaaaactttgcatacaaggaaatctaatatcgcagccttccccactggagggttcctggagaaggtaatataacagtggtgactgaatttgaaggaggttggagagaaattttttaaaattatatttccatgtctgctgtaatgtatccaagtcttgtaaagaccaataatttattaattttaataagacagaaagtatttctccttctagtctcatcgtctgatttgaaaggaaaaaatatatatataaaacattatataaaaagtgagttccaggaagaaatgtttttcttttttcatataaaatggtagctgtatgtatgtaactctgaattaaaatatatatatatatcagtcactctggttctaaatccttattgggcaagctggagttttgaagtgacagaggaaataactgaaagatgacttgtcaatctggaacaaagtctatcatgtaaaaactgcagcaggttaactaggtgatgcgtcttcaatggggtagtgaggtgttgttcatgtctatggcttatttttgatgaatgttcctcagatatcctatggacgcttatgaaggcagtcgagtggcatttgcaaaaaaagaaaaattgcagtcagagcacagacaccctgaatgaagcccctggcatgatgtaaacacaaaagaaagtgtctcagcaaggctgagccctccttctcgtgtctgcattgcttccttttcccaacaattgtagatcaagatcaacctcaacttgaaacccaccagaggccaccatgcactgtgacacattatttaagagctcctattccccaacctggcttcccttacaaaccccgctttgttgtcagttcctaagcaatcattctggaatccacatttcagaagacgtggatgtaagttgttttggagtcactgccgagaatgttttttgccatgcacttgtagaagccggcatctctctgtgtggcatgctggatggtcagtgatccctgggggtgaagaaatctgtttccatacagacgagcctgaacccctgccttcagatgcgacttatccggtaactcccacgtgatgtcagctttgggaatccccatagccatgcagttcagtttcacggtgttcccgggccgggtgtagatgaccggggtgggctcgctggtgatccggggaggataggcgatcacaatcacggggatgctggtgaccgaagggccgtactccgtctccatcctgcatacataggtacccctgtcaaacaccgaggcctcacgaaccgtgagggtgccattgtccagaagagaaacgcgtcccagggtttgggggccctccagatgcatgccattggggagcgtccaggagaaacgtccctgcccagccccgggaggggtgcaggggagcttcagggtctcaccattgatgatgctgaccaggttatgatactgcttgtttgcttctggcttcagtcccaccttcagggagaccagcctctccgtgtggccagcggcattgcgggccacgcagcggtaggccccggcgtccaccgaggagagaccgctaatgtgtagcatgccgtcagccttgtggtagaagcgctgcagctgctgtccactctgcagatcggtgccattgggaaggacccacaccaggctgggtgtcggggtccccgcggcagagcagttgaggctgatggtgtggcccgccatggccgtgatcttctcgctgatcgggtcgtggaagatgggtttctccatgggctccaggacagtgagctgcaggatcaacctggcctcccctccctcgttgcgtgccatgcataccagctggacggagtcgctcttcctcaaactcctgatgtccagggaaccgttgccatggacagtgatccggtttccatagtatggagctggcagaaccacaccctcgggaaaagcccataacaccctcggggtggggatgccttcagctttgcagtcaatcagtttccgactgcccccggctgctatctcccgcacagtggtgatggggttggggttaccgttgatcttgggtggctggacgttgacgtgaatccacaccgtcttcctatcctctcccgcgctgttcctgaccaagcaggtgtagttgccgctgtcagaacgctgggctttctgaataaggagagtgccatcttggtatatctgatacttctcagaggaggtggggatcaccttgttggttggggacaaccaagtcaccttgggcatgggttctcctttggcctcacaggctacagtgaccacgtctccatagggcacctgaaccgccaagtaagtcttgttccggatggtggcgggcgctgtcaccaccttgactctgactctcatctcgtccttcccgacctgattttcagcaaagcaggtgtagtctccttcctccctcatccccacttcgttaaagtagagtgtcccattgttgaagacgacatagcgcttggtgcgtccaccgctgtcatccgactgcatgaaggagttcaccagactcccgtctgggaggctccaggagatctcgggattgggaagcccggtggccacacagtccactttcaggtcacccccgtagaagactttgtggtcgttctcctccttgtgttcaatcttggccggtttcatcaccacatccactttgagcaccacgtagtcatcaccaaccttatttcgagctacgcacaggtaatctccggcatctttgtccgtcactgatttcaccaccagggtcccattggcaaacaccttgattctgctatcaaaactacagaaaaaaagaaaaaggagtaagatgtcagtttcccaaatgctctagtgtggcattaggtcgctggaataacacaaaaataggtgtttctgtgatgcatcagctcaggtggctgctattgcagaatgcccagtggtttttacagcctggagaaggttgtggaaagtgattgactgcaaataagaactccctgttgaatctgatgttaggctggcctgaccatgggttcaaggacatgaaatgtagtcaaagacgtcaatcccattcctgcaagtgtgtgtggatcaagtatttgcatggtggtcattacagaggtcattgtaacaacaaaatcagataaaatgctacagtcatggagatggtgaagaatctgggtcaaccttataaagatgttaaattcttcctggagaaaatgctttagacacggtttctactcttggcaatttctttttttaaagctgttgtatcccagttttgggcaagagtcagaaaagcaactctaataaggtcatgtaattatggttatgcccagagtttcaaggtgagttttaaggctaaaattgggatcttcagaagctggccctattggtgtaacaggttttctagaatttgtaattaaagctgaataacactcactagctaaaacctcaaggctggtgtgtcattcttccccatgaagtccaagcactgccgagttaataattacaaaaaggtttaacagaggcaaactagaaaggatgataggaaaatcttcattatgtatgtaagagttttataaatactgaagtatcctttagttattcggaactaatatgttgaataatccagtgaaaagattgagaaagttctcacttttaaagttgtccctattgaattctcaattacacatacattataatgggagccttaatatttcctaaataccacactttcttttttttttttttttttaagaactgagatcttgtttgtcacccaggctggagtgcagtggtgcaatcatagctaactgtagtctcgatctcttggactcaagggacacttccatctcagcctcctgagtagcttggactacaacaatacaccaatatgcctggatggagttttttttattttttattttgtagagaagggatcttgctatgttgtccagactgagtttgaactcctggacttaagtgatccttctgccttggtctcccaaagtgctgggattacaggcatgagccaccatacctggcaagactccatttttctaatggcatgtctaagacactgtcatagatcttttaaaataagcccagttgtgattacattcaacctaatcattgtaataaaagcaatgattaacaatgaccatatacactgttttgtgggccatgagtgagaatcaagtcaatgtaacttggtaaggaatttaacaggtgtgggacaggcaaggacatttaaatgtgccttggaatttgaatccaaaaatgagtatggtagcatgtgtctgtaaacattctgaggcttccattaacagtgacccctagcccagttgtcatcagaatcaactgagcaaatctcaaagccacagatgcctgtgcatcgtgagagattcagcttcaagaaacgaagctctgatatttgtttttgtttttgttttttgagatggagtctcgctctgtcacccaggctggagtgcagcggcctgatctccgctcactgcaacctccgcctcccaggttcaaatgattctcctgcctcagccttccgagtagctgggtctacaggcataggccaccacgccctgctaatttttgtattttgagtagagacggggtttca[131 bp omitted]gagcctgctctttgacaaaatgcacatggtttgttcaattacactttactaagaatatagtcagaatttactaagaatgaagtgacagaaataatggtttataatttatttaggatttatatggagacattaatggaatgacccaaaaatcttactggaactgcattcttatactgttatccattcaaaattgcctccaccatgccaaattcaatggaaagcagttctctatgtggcagcacatctgctaagctggaaggcattcctgggtaaattgggtacatggctcttctggattgattgtgcaagctcttcagggcaccacccagccatctaaagtataaaatacaggcagggaaaaggcatctcagcccttttcctgaattgaaaagagtcctgggaggccagacacaactgtgcagaagaaaaccttggacgctgattttgctcctaccctggggagggacccacggtaagaggctttcctgctcgagctactgagtgctgaagacagcacaatccaggggttctccaccattgcactgtgaatttagttggactccattttacctttcctctactatctgggtcctctattttttgaaacgcttattaaagagatattagctctttttttgtatctagctcagggtttctcaatcttggcactagggacatttggggctagaagattctctgtgatggggccatcctgtgaactgtagggtgttgagcagtgtccccggactccacccaccaggtgccagtagcatccatcccatctgtgataaccacaaaatgttgccagacacagccaaatgtctcctgggagtaaaatctccttggttgcaaacaactgccatagctagctagctagatagatgagtagacagatagacagatagatacggatggataaatggatggatagatggatggatggatgaatagatggatacgtaagagataagaatgaatggatggataggttaggtagatagacatggatggatggataagcaggtatatagatagaccaacattttcatactaagatagggtttcttggcttcagtactagggacatttaaggctggatggaggattctctgtggtgggtctgtcctgtgcactgtagggtgttgagcagcatctccgggctccacccaccagatgccagtaacattcatcccatttgtgacaaccaaaaaaatgttgccagacatagccaaatatctccttggaataaaatctccttggttgtaaacaactgccatagacaggtaggtaggcagatagatagatagatagatagatagatagatagatagatagatatgggtggatgcatgaatgaatagatacataagagataaagatggatggataggttaagtatacaggaatgaatgaatggataaatagataggtaaatggataggcaaaatcttacatgctaagacagggttacttgacctcagccgtagtaacatttaaggcaagatgaatgctaatctggggtggggtgtcctgtgcactgtagggtgttgagcagcatcccggggctgcagccaccatataccagaagcacaccctccaccccagagtcatcatgacctaaaatgtctccatacatcaccaactgtcccttggggactaaggaacacctgatgcctggttgcaaaccactgccatagatgatggatggatagacagaaagacagacagatgatagatagatagatatagatagatagatgatagatagatagatagatagatagaatagatagatagatagatgatagatagatagatagatagatagatagaacctttcatgctaagacagagttacctgaccttggcactatggacattgaaggtaggatggatgacaatctgtgatgggccatcctgtgcactgcagggtgttgagcaccgtccctggcctccacccaccagataccagaagcacccactgccccatttgtgataatcaaaggtgtcttcagatattgccaagtgttgtcttggggcaaaatcacccttggttgaaaagcactgccataaacctgtatatctgggaacagatggcacttgattagaaggtggcttggctttcttcatagcccaagtacatttttatcatttcaagtgcactatgttggtgtggtaatgatgcttttaaaacaatgtatacactttgactctatcaataatgtcatattaaaataaagcctaacacgtctatgtattttgttgaaatcaataatggaaatagaggcaagctgaattgtttgtcctaacattatagttaaacatataatcattaaaacaagaatttcttggttcatttatccttttttcctttttttttttatggggcaagagaggaggaagttaagtatttgttaagaagttgagtatttgttctggatccgagtttagagggaca[168 bp omitted]gaggcaggagaatggcgtgaacccgggaggcggagcttgcagtgagccaagatagtgccactgcactccagcctgggccacagagcgagattccgtctcaaaaataaataaataaataaataaataaataaataaataaataaataaatcacacaccgggccaggcacaggagctcaagcctgtcatcccagcactttgggaggtcagggcgggaagattgcttgaggtgaagtgttcgagatcatccttgggaacacagcagaacccatctctacaaaaagttaataataataataataataacaagccgtgcctcatggtgcacacctgtagtcccagctacttcaggaggctgaggctggacgatcgcttgaacccagaagtttgaggctgcagtgagctatgatcgcaccactgcactccagcctgggcaacagagtgacaccctgtctctaatgaatttattattattattatttgagatggaatgtcactctgtcgtccagggtggagtgaagtggcatgatcttggctcactgcaacctccacctcccgggttcaagcaattctcctgcctcagcctccagagtagctgggactacagacgctcgccacaatgcccgcaaatttttgtatgtttattagagacagtgtttcaccatgt[137 bp omitted]gtgtgcatattcatcctgaaaaaggactcatattcgttggggccaccagcccagcgatttacaggaagccacgcagagctgcctacctgaagagcgcgtcgatcatcctcttggacggcagcctccagaggatgcgcggccaggggtcccccgaggcgctgcagtccagcttgagggttcctccgtacctgacgtccgtcctccgcggggaggtgcccgtgatgcgcgcgttggctgctgcacgctgcacgttcagctgcaccgtcctgcgcgcggagcctaccaggttggcggccacgcactcatagcgcccgctgtccttgggcgcgaggttgcggatgtagagcgtcccgttggggaaaacaaacaagttcccgtggaggaactgcgaggggcggatctgggtaccgtccccgagcacccagcgcacgctgggcaggggcgcagccttggcagtgcagtgaatgtgaatgctgagccccgggggcagcgagatgttctccagcttctcctggtggataacggggggcagtgccgccacgtgcaggcggatggccaggctgtccgccccggctgcattgctggccacgcacttatagacgcctctgtctgagaaggacgcctccttgatggaaagggtccggttttcgtgcagggtgatgcggccctccacgggggacacagtttgccacaccctcctgtcagggaagatccaggaaatttggggggctggggtccctttggccagacactccattgcaatggtgtctcccaggtagacagtgacgtcctggtagtgggaggctaggatttgaggttgctgcacggtgaccgaaagcaagaccaccatcctgtccaggccgtgcaggttgctggcggtgcacatatactggcctcgatcttgtacttgaaccttccgtatcactaaggtaccgttcttgagaacctcaaaccgttgtatcctggtattcggagtcataagagctcctggagaaaattaacacagtcagctttggcataaactgtgcccttttgataatgctcaaacgagcagtattagttaatctaattctccactttaacacccaggcagcaaaagcaaatgtagtaggtagaatgttttagtgtttttaaaagttttttttatatttattttattcgttagagatagggtcttgctgtctcccaggcgagagtgcagtggtacaatcatagctcactgcagtctcaacctcctggactcagccttctaagtagctggggctacaggtgcaggccaccactcctggataatttaaatttttgttttttgtagagacatggtcttgctgtgttgcccaggctggtcttgaactcctgacctcaagtgattctcttgtcttggctacccacagtgctaggattacaagtgtgagccaccacacccagcctgttttggtcctaaccatgaaagaaatgtaaaactgagatatcatctcatgcctgctggaatggttattatcaaaaagaccaaaaacacagacactggtgaagatgtggagaaaagggcaccctcgtacactgttggtgggaatgtaatttggtacaaccactgtggaaaacagtatggagattcctcataaaactaacaatagagctgcctatggtctagcaatcccactactgggtatttatccaaaggaaatgacgtcagtatgttgacaagacatctgcactcccatgtttaccacagtgctattcacaatagccaagatatggaattcagctaagtgtccatcaatgaatgaatggataaagggaatgtggtatatatgcacaatgaaatgccattctgtcttttctttttctttaaaaaaaaaacaaacaaaaaacgaaattctgtcatttgccacaacataaatgaacctggaggacattagattaagtgaaataaaccaggcacagacagacaaacactgcatgatctcacttatatgtgcagcgtaagaaagttgaactcatagaagctgaagcagatagtggaatggtggttaccaggggctggggatgggagtaaagggaagatattaattaaagagtatgaagttcagttaggaggaatatgcttaagtgatattatactcatggcaactatagttaataacaatttagcttatacttgaaaattgttgagagtagattttgtgttgtcatcacacacatacgaaataagtatgctgtaaaaaaaggatagagaaaaagaatgttttgtttctctttttcatctttacactaatcccagaaacagggccatcttcaggcaaaggacagcaaatgtgggtttaatagagaattctggaagcaggcatgagtcccagccacttccaaggtgagctaagatgccacaagctcaattactagagacacagcctctcccttatttatttatgctcatgctgttctcctgaactcctcgggctagctggctgcatgggcatcccaggcttgcagtggccagccacccctgcccagagaggcccttgagtccataagaaaggtaaattaatcctaaagtaagactccagtaactttctcctacacaaactctggttgaagtgtagattgggtacatatggacataaagataggacaaatagacacttgggactagtagaggagagagggaggggtggcaagggttgaaaaatgtacctattggatgctacgctggctacctgggtaatgggatcatttgtgccccagacctcagcatcacacaatatacccgtgtgacaagcctgcacatgttccccctgtgtctaaaataaaagctgaagttataaaaataaaaataaacacttattcgagtaaaaaatttccccaaatgtgttataaaaatttctcctaatgtgtttatgttgttcaccatatactgttttaatgtattatattgctagccaataaaataaaaattgaccaaaaaaaaaaaaagtagatgcttaaacatcttacctgtggaaacctttgtccaagtaacgaaaggctttggttttcctgttgcctcacaggggaacacagtgtctgtctcagcggtgacggacacagtctgtggggacttggtgaggatttgtggcttttccccaagagaccagaatttggatgcaggaggtcctcctgcaaagaactttgagctgctctggtggaagcttcctgaggactggacagaagatgttataaaggagatagaactctgggtggaagagaccatagggatattctgtaagttagttgagggtgatcccgtggtctgcggagtgtgcaacaacggaggtgccggagggccaaagtccagatggaaggtgctatgggaatgtatcctgttgtaggaacctggaataacttttctctctctcattactggggcaggagaagtgggtatctggggtctccgggtgactcccaactgtggaaaagaaagagtcttgttggtaaagaaagggagtcttccattggaataatgaggaattcttggactgggaggctttccaactgggtttcttgcctcagggatgttgttatttccaaacactttggagtagccattgaattggtcagttcttcggtcagtaaacttactaggaatgctgggtttggacatgtgcaatgggagaggaattgttgtacttgataatcttggagttgtaaactgtttgttctctggcaaagccccagaaggatatgtagttatttccggtttgttggtccagtgacgaggtgactgggaagttacaaagtatctggaagcgctttgtgtggacatttcaggcagcctcactgttgctgttggtaggatgggtttggcagggactctggttagttgatgagaagcatgaactcttccatcctggcgttggctatctgggccacgtggtagactcctactaccaaatacttgcttttccaattccagctttgtagacaagttaaatgcatcctggtcggaagagggtgttgataattcatttggccctgacatatgctgtgttccttcattgttcactggggttgcttctgtttctggattccccacataattcaagaaaacattttccttggaatctctagatgcttgagatattcttggactgggaagtgctggcttagtggtggtggtttgtcccaaagacatgagaattgtggatggggacgaggatgctggctccttcatccgggcagcagtaggggtgtgattctgtggtctagtttcagaaaggagaatagccacagtggtttcaagatgatcttgatcaagggtggtggtttctgcctgacttgaagccacctccacttttatgcttgagagagttgtggaagaaccagcttcttcctggtgaaatggtgtggagactgtcaaagaggacaaaaactcggaagtgaaatccacatcctcaagctctttaagaaggggagggtctgtaagattttccccagaagtggtaacaggtatgcctgtctgtagcctcccaggctgggccgtccttgagggattccaggttggagttcctggaaagcctacaggagaggattcttccttaaattctcccatagtggagaccaaggagcgagaagttggtatggcattagtaattgattcaccagtgactaaaatgtcacttttatgtttgtcaacatttgtggcaacatcatccttaatttcttttccatctgatgtgggtttatatgtgactggaagtgtctcttggactttagggtaagatgaatatatttttctggtggttgtcatgtaatctaaggaatcataagggccctcagttttcagagaaacagttctaggcaaaagtatagtttctgaactgggagtaacaatgtttctatgtttattttctggagaagggctgggcttggatccggacgctcttgagctcactgtagaaggggtatatcgatgtttgtttggcctcttcccgtgttttctccgtggtgttcccttggatgtgggttctgcattcttctccatttccaactgtttgggggtattaactgtgttatccacccaagctgtaggaaccagagaactctccacttgacttgaaatcttaatgtcaggtgcttgagttggttgagtagaaaaagtctctgatggggcaaaagttgtgggtggggtttgcttgtgccggtggcggaatttgttggggcgtaatctccttctcccgttgggtctccttcgagaagggtgagtgctcatggtggatgacggagcaactttttgccttggtgttgttgttgctgttgtggtgtctttgtctaggagggtaccaactgtggtttccgcaggcttcttaactggagacatactgctcattatacccagtgtggagtcaggcaaagtgatggatttgctctcttggccctcactctcagaacttctggagtgtgtggggtctccctctagcatatttcctccctgtagtgtctgagacatctctttcataccctttttaatcagtaaggtgtcttgagtgcttagactacttttcacaaggtggatgttgtctgtcagtccttgtagatgtgattggcctgggacacctggttcccctatagtagaatcctcaaataactgtgatgtactggagtcattaacccagatggtgggggttggagtaaggtgtgcaaaggtgtcttctttcatcttatcctcatctggttgtgacttagtctccaaatctgggtcaaagtattgcatgggctcagactcagccaaggagacagcatccaatggaggctcatactcactggatgtgggctctggtgacgatccaacatctgctgcagaccaaccctctgttgccgtctcttcatgggtgggcttttcatagactgtgtctaatgtgtgcagagtaggagatggttcataaggctcagatataagtgtaggggctgctgtccccttcaggtctccttcagtggaagttatctcctcagtcttctcggaaaggtcatcaacaacttcctccagaggtgtgcttgttacttcaggttcaacaagaataactccattgtggttgtgttctagccccatgctggctgaggaaatggtacccaaaacgtgctcttcttcaccaagtagaggtacatctgctgaggattcttcagcactggttactgtctgcacaggagatgctgaggggggagaaatagcaggaaaaggtggtgtgacttctagactcaaggatggaggacttgtggttttaatcaatgggggtacttctgtgcccttagggagatttttcccacggactttggctaaaatatcagcccagcgctccggattaatctgtttgtttgccatgtttatccttcgtctagattcaaacactctgcgaccttctgcaacattggtctctggttctttttccgaatgcttccagagtttcagctttcttctccctttcttggctttcttgtctccattgatggcatcatcctttgttttgaggaacacctcttggtcctttggatgcagaagtctccttgaagtgttctcttcatctcccatgcccgagcccccttcatcctccacgatgtcttctctgactctggaaagagcctttgcacctgggcgtctgcctcttttggatggcaagccagaccctttcttggtcactgtgattcccaccgtaaaatggtctgccccttgctggttgacagccacacatctgtagtaaccactgtcactgacttggacctttgggatggaaagagttccatttggcaacatgtatacatgtgatgtgttagccaaatcattaattatccttctgtttggaagaatccagctaaggtgggcttcgggtattgctaaagcattgcaaggcaatgtcaccgactcccctgggttcttgccaattgtcactgtgtctttctcggctggctgagtggagggagactgcacaagtaccctatataccatgcggtccatttcatccctcacttgagcaatgcactggtacaagcctgagtcagatggctccatggacttgatcctcagccagccactgctgagaatggagaacttgctgtctgggtcatccatgggcgctttcaggatggagccatctggaagcacccagaagatagatggactctcagaagctttcacgttgcagctcaactggcatggacccccttccaggacagtctgatctctttgcacagctccactaggctcaatcattacccagcttctgccccgagcctgccttgtatctttggtggatattgtttgagaatactgggtgtagtaggaaagtagcaccttcttggccgtactctgacgtcggttcagctggatatctatggatggctgcatgacccattctggttctgcaagaatctgggctctcacacctgtgtagtaaagagcttcctcatcagcatcctgcctgtactggtagctgactctggggtctttgctgagcatgagctctctgtgtagcttcacgggaacttcactgtagtatgctatcaatttccatagcttttcatagttttctcgggtcattggacactcaaagtccaaggcaactgttgcatttatgtcaatatctggaggatccgtttggttcaagtgaatcttgtacacatccattggtttcttgatgtcacagaccaagttcaccatgttcccgtgctcgtcggtcatattcaaagagatgctccactggggcagttggaatttctccaggatgagctggctgccaccatcctcttcctgttcttgctcctcctcaatactcctgctcctgttctgtctcagaggggactctattgaaggcttcagacaagtcatgtccttcagcttgtgtatctcatgtttgtacaacttctttggactgaagcacattgcacacaactgaccgccttcataagctttgtcctttttacacttcagaattcctaaaacaaataagcaaatagacaatagggtaaggagccaaagaatggcatgccttgcacatggccagaggataaagcctatgtttgcatctttatcacccagctgtaatcccataaacaaggaatcctatacatgagttgcctttgaggcttcatgttaaaccacagttttagcacactgtgtggtaactaacgggtgctttataactgcttaaccattaataataatttttacttaaaaatgtcttaaaatacttactaacgggtatttaaaaaacatttctaagttaaagaaaacaacttcattcacatacattttacaatgtaacttctgtgaaagtttaggagaatctatataaatatactgcaaactggggaagcatttcttggtaaaaggatgaatctttgcacgtatcacatcatatctaatttttgttgtttttcatcttgatatatataccaatatatattaaaaaatcttgatagatatctatctcaatatatacaaatatgtatctatcttaatagatatatagatagataacatatagatatataatacatatatatttatataatatatatctatcatgatatataaacatatattgatatattaataaatatatattaatatgtagatatattgacatataatcaatgtatatttatatctaagtatatataaataatatgtaaattaaatatggatataaatatataaaccccttgaaagtattttcaggtaaaaggaagaatctttggcatgtatcacatcatatttacttttttaagtcatgatataacaatatataaatttatagatgtacatatatttataaataaatatataataatatatttattcataaataatttataattataatttataatatataatttataattataatttataatgtataattttaaatcataaatttataatatataatttataattgtaatttataatatataatttataattataaatttataatatataatttatatattatatattatatatatttatatgtattttatatataaatttatatataaatatatttatatatatttatacataaatacatttatatatatttatatatatttatacataaatacatttatatatatttatatatataaattatatgtaatatataatttataattataatttataatatataatttataattataagttataatatataatttatatatttatatataaatatatatagtcaatatgtatgtatctgggtaactatatctatatttataactctctatatatttatacatttataatatataatttgtatataatcaatatgtatctatctaggaactatatatttataactctgtatatttataatttgtaatatataatttatatataatcaatatgtatctagggactatatatttataactctctgcatatttataaatttgtaatatataatttatatataatcaatatgtatgtatctaggtaactatatctatatttataactatatttatacatttataatatataatgtatatataatcaatacgtatgtatctaggtaactatatctatatttataactctctctatatttgtagtaaacacttcacagagtgtttgcttttgagttcacgttgtcctcttggtctcctggatatgaaatcctctggaattttctccgtcctttctggccacaactgggtctcagtcactgcttcctcctcctcctctgcctgaatctttgctgactgggtcctccttgacttgagcctaagcccctttcctttctggtcggcttcagcgtcaatggcctctcgcatatgtgtggttccaattaccatccacccgccagtgatgactaccatatgtgcttctctagtccaaacacattccgtgagttccacaccccattgcctctttgacatgtctatttagatagcaagaagagtcctcaaactgacatctatgaaacaaatttatattctctccctgacctaaatgtagaatctcgtgcctgttctatctcagtaagtgatgccatactctctctgcctggggaaactggaagactaggagtttttcatggcagtcctctgcctacttctgcccgttcccattgggaagaagccagtcatactgcttcatctatgacttggagaattataaagctcctaactggctttgccatctttccttttgccctcctgaccatggttttctgtgtgactttcaaagcaaacacctcaacatgcgaataggattgttttgcacatctccccccaacacacatacacatactcacactcacactcatacccacacacatacatgctgtgagacaaggcagcaagcacaagcaggagcatttcacaaaatcccttggccagctgaatttcatggctcagcgaatgagcgcagcctctacatgaatgccctgaagatgatgagcaggatggagcacaggtccacatgtctcttgcctgaatcactgcacttttagaaaagatgagttcaatgctcctagcccctgcctctttctacacataagataatgtctggcaggattaaggactatgcctctgtaatctataaccagatgtcccctggcacccaaactttgatgagaatcagctctaatataacttctgagcacaactgatgtgaattctgaccacatttggtgtgacttctgagcacctgcagaaactccaccatctgtgtataagctgtgggctgaaaccttgctatgcagcagtctaacagaaactctctgaaagatcctgggattgcaatcttcagaaatgctcactatataaaactaaccttaatactttacaatcttgagtttctttcacatacatgcaaatctacacatacacagatgtacacacatgtgcacaaatacatgcatagacatgcacacacaaagacatgcatgcgtatctccagacagtagcagagatggttctttgcccagcaaagttttgtgggtccacatccataatatagtgttgctgctacaaaatagccatccaaatgcattttcaggcccccttacatccactggggtgtgaggactggttcccaccaatgaaatatgagtggaggaggcgtgtgtcttttctggttaagaccattcacaagtgggtgtacctctgtctttcccacatccattgcttgatggcctcttggaatgaagctctaaaagctaagaaaaagcaagcctcttgaatgtctagcagtaaagactcccaagtaggcaactgagcaaatccaatgatgttgagttggaaataagtttagaagctgcaaggaacagacgggaagactgtgtggctagaaataaacgaataagaagagcaatgggaccaccatgctagaggatagtggggacaggtggagcgaccattgtgtggagacttcttggagggaatgtgcaaatgtgtatcttatcctaaaagcaatggaaatcagttacgcagaggtgtggcctgaatgggtgcacatcctgtaaaaatgttctcactgctttgtagagagtgaatggaaaacagggctgacaaggacatggggacacttgtttagaatgctccccctttctaccagagagaggaaaggagcttgatccaggccagcagctgtgaggatggagttgaggaaatagatccaggatatggtaaacacaatgcaatctaaggatggggataggttgcaaggtagggcttagagaagggggagaaaggaaggaaggaagggaagatagggagggagggagagtgaaggggggaggaatggaggaaggaagagagggatgaaaggaaggacagaaggaagaaaggaaggcaggagagaaggcaggaggaaggaaggaagaaggaaggaatgaaggaagggagggagggaaggaaggaaacgaaggaaggagcgagggagggaaggaaggaaggaacgaaggaaggaaagaaggagcgagggagggaaggtgggaagcagggagggaaggagggaatgaaggaaggaaggaaagaaggaaggaaggagagaacgaaggaaggaaggaaggagaggaggagggaatgaaggaaggagacaaggaaggagtaaaggagggaaggtgggaaccagagaaggaaggagagaaggaaggaaggaaggaaggaaggaaggaaaaaatgaaagaaggaaggtgagaaggagggaaggaaggagagcaggaaggagtaaaggagggaaggtgggaagcagggaaggaaggagagaaggaaggaagcaaggaaaaaagaaggaaggaaggaaggaaaaaagaaggaaggaaggagagaaggaagaaaggaaagaaggagggaaggaaagaaggagggaaggaaggagagaagaaggaaggaaggaaggagagaaaaggaaggaaggagggaaggaaggaaggagggaaggaaggaagatgaaggaaggggagagaaggaaggaaggcagaaaggaatcacaatctactttgttgcaactgcaacacataagtcctggttgttgtcatagctctctagatcaatagtgagaatcgcttccgtgtccgtaaaataatgaccttgtagccactcctctcaccagcctgctcttttccaagcatcctttgtgaatttctcatggaacatggattcacagccccttcccagtcccagtttcccacattaagctgcagtccaaggctggcatgatcctccagatacccattccatggcaacccacatcacctgtatgtaactgattacatgagcactacatttcactaagggataactgcctttgcgttggggaatggagatgtcttaacatttaagtggtaacgtttaaagtctgagttcctgtctagctgattgggtgctcagatttcatcgaagctcagatttcattgaataagtcaatataagaaccttggagaatggaacgtctccaaaaagataaaagaatgtgcagctaggagtggtctgctctcctctcttcttacctctggattttgcatcccattccaaaaaccatctcatctcacaatcgcaggtccacggatttccctgcaagtaaagattctccagaagcggcatgttccgaagcatgctggcaggaagagttctaaccatgttctctgctaagtagaggtgccttatggtggagagtctgaaataatccaaaaatgtgaacgtggagaaggtgctggggtgcagctggtggaggagatttccttccaaatggagtagcctcagagacgttaagccgttgaaagcttgagggtggataaactcgatcttgttgtggtcaatgtgcagcctcattaagttagagagaccctggagggtctgtcctgtgatcactctcagcttgttgtagctgaacttgaaaacctgcaaggacaggggaaaacaaaacaaaacaaaaggatcctgtttatagtttaaaaagccacaaccacaaacagaaaccagtacaaagggctggagagtaatgacatgaagcttgtctttcatgtcaaacaatagccgttttattgatcattaaggagaatgacataatttctattctttattactggtcttagaggatgcaatttagtgacgcttataaatgccgtgggtttacctgaagagagctgaggtctcttaaagctccatcggggatgcttgggatctcattgccgtgaatcataagtagctccaacttggtcagtcctgcaaatgaggtttctgacagggcctgtatgctattaaacctaaagaatggtaataataataataacaataataataattaagaaaataaatagcgaatacttaactcccatatgggaaacattccctagcctgcccaagagcaaattagtaaaatggtgagtctttttgtctatttatttatttattagagacaatcttactccgtcacccaggctggagtgcagcggtgcaatcgtagctcagtgcagcctccacctcccaggctccagcaatcctcccacatcagcctcccaagtagctggaactacaggcacaggccactatccctggctaattttttatttttcatttttgtagagacagggtcttcatatgtgcccaggctgatctggaactcctggcctcatatgaccctcctgcctgggctcccaaagtgctgggattacaagcaagagtcactgcacctggtcatgaagtagtgattctgaggttacaggggtgccattcccaaagacgtttatcccttcgtgtccctatctctggggtcaagaagaaagtgacatgtatttatttgtcttcagtctgctaaggaacattcatggagaactttgacttggaatatgctgttgtggtcaggaggctatttggtgtgtccatcagtaggatttagaattcaacatgaggctgttccacgtgtctctttcttggaaactctgtgctgaagtgacagtaataaagagggacacgtggctagcagggccgggaaaatccacggcattggaatttgctttgcatatggtaagaaaggagacagctccatgctaaaggccaaatagaaatgttgaccacagacaccaacactcttatttcccatggacaggctgccatgtctgacggatgatcaaagttactcgtagacatgctaggtttcttgtttgttttgtttcttcctgtaacctgtcctcaagataagttctttttgttttaaatttttggttttttgttgttgtgtatataattgtcaagatgctttcttgaccaatttagaaatttctcattgccatattggtaatagcatacaacaatgcttaaacttgatccctggataagcaatttgaaaaaggaatagagaagcctgcacgctgttaccataaatcactgtttctgctgagacataacacatctagcctgatatcactgattgcttcttcttatcacttacataaaaggaaatcaattagcagggaacataagtgaacagctcatagctaaatgcagcagatactagcatggtccaattttctcatactcatatgtgctcaaacctggactacaattccaaagtcaacagaaacaccaggttaggtgtgactcccctaagacccagccttaggaagcacctttcagctacaaatttttgagtgcaggaaatttataagctctaccctcaaaaaccattcaccttgattgcatcaaacttttcaaagacctcctttcataattgcattcttcttctttttttttttttgagacggagtctcgctctgtcgcccagtctggagtgcagtggcccatctcggctcactgtaagctccgcctcccaggttcacgccattctcctgcctcagcctcccgagtagctgggaccacaggcgcccgccac[187 bp omitted]gatggaattaaatgcatcccaccttattgaaataatgttgtatagattcaatatggtgtatggggaaaatatagtagaagatgatcctatttcctgttcatcattttgactcatgtagtcaatgaacaatcatatatagtggttctctcttcttgattacatgatatttttcactcttctttttagtgcattactccagtgtcttgtcagctaagctctgctttatttaacactggtgagaggtaaaatattaaaagaattgggctcatagctatgtgtgtaccttatgaacatgctttggattccatagaaggtgggaaacttagctggaattgagccttgtcctctttgtattactttttgccctttatcacctaaaccccatgaagcaggccaactttccacagcagaaactgagtttcaagaaagtttccaggctgggcatggcagctcatgcctataatcccagcactttgggagggtgaggcgagaggatcacttgagcccaggagttcaagaccagcctgggcaacatagtgagacctaatctctacaaaaaatacaaaaattagttgggtgtgatggtgcatgcctgtggtcccagctactcaggaggctaagcagggaagaccacttgaacccaggaggttgaggctgcagagagctgtgattgtgccactgtactccagcctgggcaacagagcaataccccatatcaaaaaaaaaaaaaaaaaaaaaaaaaaaaaagtaagaaagaaagaaaaaaagaaactttccaaaattttcaaggaataggaaaaaagaggataaaccatgcaatgttccattccaaagtttttttcctattacctagtggtactttggtcttattaaaacaagatgggaacttaaatattccacaagcaaacacagtgacaacaacaataatgtcccctttacaaagaagaggagactcacagaagacattgaatgcattcaagaatacagtcagtgagagtaaaatccaggtatcttgagaccaaagcttcaacctgcattcagacactgttaactgaggtgggagaagctgtcaatatctacttgacattattttatttagtgagttcaaattcatggaatcatggtgcaaaactccccgaaatataatgctgcaaagataagtgaaattcaagggcatgaagctttatttcatgttaaggaccatgaacctcctcagtgggtaaaattccaagtaagagaagaaagaggtgcattttttccaatcatgagctcagcagtttcctgcagagtataataaaggggaaggaaggtgttgactactgcaagctgggtggggaaaggaggtcccagtgtgtagacgtgagatccttagaggtgagatagaagcatagaaaggtctctctctctctctctcaagacagggtctggctctgttgtccaggccagagtgtggtggcacaatcttggctcactgcaacctctgtgtcctgggctcaagccatcctcctacttcagccttctaagtagctgtgactacaagcacacaccaccacacctggctaatttttgtatttttagtagagatggggtttcaccatgttgcccgagctggtcttgaccttctgagctcaagtgatctacccgcctcggcctcccaaagggctgggattacagatgtcagccaccacaccctctaggcctcatgttttgaggtcaggcacacttcacgttgcccgctggctatcccagagaagttaccaagctttttggaagctcaaactcttcattagtaatgctactgaggattcttttttcagagagccctgtgtgggttaaaggacataatgtctgtagccactcagacattgctctgtgtcaaggactgctacagagtttctggagggaataggtacaccaaggctgataccagggagatcaaagggaaagtcacagccaagcaagacacaaaaagagacatgctaagaattcgtgagttaaaaatggcaactaaaatgtagttaggcaggggaataatgagcaatatgttatatgaataaagacattcaatgaaaacatattcagatgttcaaaaatttatacataatatgaataatgtaaaaatcatacaggaatcataatattcgtaaacatgtccattcaatgattcttctcagagacactcaaatgaccaatttcagacctgatttcagctgactccagagtagaaatctacctgatacatttctaattcattctttgctacgttatctttccaggaactttgcaccctgattccatatgtttcaactcactaaataaaataaagtgtcaagtagatattgatagcctctcccgcctcagttaatcgtccctgaatgcaaggtaaagctttggtctcaagatccttgtgttttaccatagtgactgtgtattcttggatgcattcagcgtcgttcagagtctcctctcctctataatggggacattattgttgttgttgctgtgtttgcagggtttttaagttcccatcttgtgggtaaatgaagtgtcaatcatggataatgaccatactaagttgccattttttattttttatttttttatttttattttacttatttattcatttgagatagagtctccctctgtcgcccaggctgaagtgcagtggcgccatctcggctcactgcaacctctgcctcccggattcaagcaattctctggcctcagcctcccgagtagctgggactacaggcgtgtgctaccccgcctggctaatttttgtatttttagtagagacagggt[132 bp omitted]ttatttcttcttatttaaacacaagcacagatgatttagcacacaagagagggccaagaaggtcttacagggtatgtttgcggatggcatcctcagaattgttcagaggtttttgtttgactgaaataacagccatgaggaaaaatgcaatgcacgtgagtgagaagcaaagagagtctaaatgtacatttcagaaatgccgacgacagagtagaagtctacatggcacatattctcattcactctttaaattgattttctgcaaaatcactatgcagtggcagtaatcattgctcaagatgcacactacaaaaaggaatgaagctctgacacaggctaccatgtgggtgacccttgaaccatgttgttcactgcaagaagccctacaggtcacgtactgcagtggtcctcaaaccccaggccacagagcagtaccggaccagttaggaaccaagctgcacagcaggaggtgagtggtgggtgagccagcaaagtttcatctgtatttacagccattccccattgctggcattactgcctgagctccacttcctgtcagatgagtgacggcattagattctcattggagcacaaatcctattctgaactgtgtgtgcaagggatctaggttgcgcactccttatgagaatctaatgcctgatgatctgtcactgtctcctgtcacccccagatggaactgtctagttgaaggaaaataagctcagggctcccactgattctacattatggtgagttgtagaattatttcattatattattacaatgtaataataatagaaataaagtgcacaaaaatgtgatatgcttgagtcatcccaaaactactccctccacaatcctgtctgtggaaaaattgtcttccatgaaaactggtccctggtgccaaaaaggctggggaccgctgatctattgtatgattctatgtatatgaaatgttcagaatagtcaaattcatagggacagaaaacaaagcagtggttcccaaaggctggaggaggagagggagtagagaatgactgcttcatggatatgaggtctccttttggggtggtgaaaatgtttggaacaagatagagatgatggatacacaatagtttgaatgtactaaatggcactgaattgtagaggctacaagggtgaatgccatgtcatttgaattttactttaaaaaattgcaaaaactttgtacagatcagcttcgtatgtgccttcaggatgtagtgggctctgaaaacaagttctaatgcttttagagatggagaaatcaaaaggaaaataaggcaggtgctgtttgaacttcgctcaatatgaaacgatgtctgctacagattctacatgcatggattcattctgcaacgcagtcacagctataatttgagctttgtgtgtctgcaagttactattctgggtgggtcaaccaaataggcaagggctcagctctcttagcaagaagcatgactagaaaggtaaaaataatgaaaaagatcatttcagatagttgtaaatttcataaggaaataattaaagcacaggaaggagagtagaaggggtttggttggccgatgtctacggcagggctctctggggagctgagatttgaagtagggcttaagaaacaaagggacgtttgggcatggcctcatcattttagaagaatattccgtggtggacaactagttagctctctggtattttgctgttggccataaagttcagagttattggccatctttctgttccttagactcaccaagcttgcccactttatggcacggccattgatttgttctctatagagatgatgctcaacatcctgtaatgcacacgatggcccctacaacccacattgattcagtcctaaacatcaagattgcagaaatttggtaactttgccttagcacgtgcaaatttgtctatctgtccctctgtctgtatctatctatctatctatctacctaccctatacctacctatcatccatcaatctatctataatcctctctatcaatccatctatcatcctatcatctatcaagcatctatctgttataatctatatatcaattatatatctattcatccatgaactgaagtatgtgttaaaacagcaatgttggccacttcctggagaacgtgtcagagctgggcaagggagggaggcagaaatgaggtgaatcctgcagagatattgagggatgttggatccatgaccaggtgtggcagtaagcatgaaggcacacagaacatttccgaatgtatttagaggaagagccagcaggcattgctgagtggtgggagtgggaatgaggacaaacttgggggaaggacttctacttggaggggagtaagtgggtggattctatcatttgctggacagcaaaggctgggagagacaggtgttggggaaagaattcaaagctgtatttgccatgggatgtttgagaattttgtaagaatctaaggggagaatagggctcaagaccaagatggagacccatgatgcacgttcaggggagactggccaaccgaccaatggaatagagccctgggagtaaataatatcacctgaacggagcccagaagaaggaggcagatcttcagacagaggagatagggctctgaggctctgtctctgaaatgggtcagaaacagctggatgttcctcagcacattttacttcaagggtgtgatatgttctccttccatagttgtggtcaccaaaaaggtctccagatgttgccaaatgttttccaggggcaaactcatccattgttgataactattgtcatagatagatgatagatagatagataggcagacagatgataaatagatagatagatagacagatagatagatagatagatagacagccagacagatgatagataggtacatagatagatagataatatatagctagacagatgataaagatagatgacaggtacataggtgatagatagatgatagatgataggtagatagatagaatacatgatagagatagattgattgatagagatgataggtaggtagatagattattgataaatagatgatagagaatagataggtagattaatagatgatagacagatagatagatagaatagatacatcaatagataatgatagagatcaatgataggtaggtgataggcagacagatgatacatagatagattgatagatagatgataggtaggtagagagatagattggctgattgatgatgataggtaggtagataggtgataggcagatgcatgacagatagatgatagatagatacatagataggtaggtagatagatatagacaggtagagagatagatttgttgattgatgatagagatagatgataggtaggtagacaagtaataggcagactatagataatagatagatagttagatagatagatagatagatagatagatagatagatagatagatattgagaaaaacagaatggctcatactaaagccatggatagctgaatgtcaaatttaacctgagaattttgatcacaactatcaaggtggagaagaagggaaaataggaacaaaggataatactggttgatttcccttcacatctgaataaattcccctttcaggaaggcacccaaagtctgggacgggctccacatcagctcagaaacctgcctgaccctgtcatcttgcccctgcttgttttgttgttgttgttgttgttttatttttttgttttttgagatggcgtctcgctctgtcacccaagctggagtgcagtggcgcgatcttggctcactgcaagctctgcctcccaggttcacgccattctcctgcctcagcctcccaagtagatgggactacaggagcccaccacca[147 bp omitted]ccctgcttgtttttaaggggcattagagagcttgcagatgcagatgccaagggtgccagatgtgagaatggggcggatattctggaacatacagaagcccagggaatcacttgagtaccccctctcagaacccaagggtatacatgtccccttcttgcatccttctaaaaatcagcagagtctgggaaattagcacgacactcagggaacagaatctaactggagactgggatgaccctgcataaagtgcagttctatggcttattagccccttggcttacattccagactatcttcatcgcctattgattggcaatcactgaatgtataaccaactctgtgaaatgtttatggcagacaatatttgcaaaattatgtcttcggttccggttaatatcacaaggcagaacttaaaataaaataggcaagtatgggcattgttgaagttgcagaaaggcatcatcaaaaccagtcttttaatagagggaaaaaaatacttaagagtctgtaaatccatctctaggtggatgctatgttgttggttcctgaaaaaaaatatttggaaagcaattttcagaaacgcttttagtttgtccaagcaggaaacagcaatgctgacaaagaaccctaaaaacagctgtgtgggaatagaaggtttcattagcacttggccaacaattcctcattccttgagagtcttatattttctccagactgttaaaacacaaatcaatctctgagttttatctgttagacattgctcttgtttcagttttttccccaacaaaatgcaagatgccagactcattacctaatttgagattgatttttctgaaacaatgctattatgatattattagtgatttttttcaagtagtatattagttcctgttacaaattaaaccagatggaagtaatagatgttgatgcagtgaagtgattctctagggttttaaactttttcttttctttttaatattacagaaaactatctctagatattactggcagcaataggaaaaagaaactttaacatgttggtatgtctgttttattcctacgttaaagtcaatctttatcgtgagttgtttaaaatgaaaccatcagaaatggtgttgtaatttagaggttagttatgttttgcacttacaaagtacttcagtttaaaaatgaacgggaagaaaagcatcccagaaactgtaaatgagatgcaaacaacttcagaagtaatagtcttgttggtgctgtaagtctcaagccattaaacaaatcacctctttggggagggtgcatgcagggactgtctccaccctcatttccagcctgatatcccccttcccaacacacaacacaaacacacaaacctgctgtgcaagaagcaccgcaaatagatatatattatgtataatagatatatattatatatcatgtataatatatattatacatgatatatataatgtataatatatattgtgtataatatatattatatattatataatatattatattatacataatatgttatacataatataatataatatattatacataatatattatatattatacatatattatatattatatattatatacataatatatataatatataattattatatataatatataataatatatataatgtatataattatataattatatatataatatataatagaattatatataatatataattaatatatataatatacatattatattatatataacatgtatatttacattatatatattattactatatattatgtatatataatatatattattattatatataatatatataatatatattattattatatataatatatgtaatatatattattattatatataatatatgtaatatatattattattatatataatatatgtaatatatattattattatatataatatatataatatatattattattatatataatatatataatatatattattattatatataatatatataatatatattattattatatataatatatataatatataatatagtatacatatattatatattatataatatgtatatttacattatatattatatatattataaagataatatatataaaatatatacattctgcatcaaccccaagctttttagagggctccaccaaggcctggctgatggtacccccagcatgggacctgccaaggtgctgggtttgagagatgaggtggctaatcccagcaagttagaccatgtgttaaaatggttcatgtataaaaaacaattcctagacagagccattttgcacaccaagggtggaggaaaaagaagttacagttaaagccccactttctgttctgcaaatatcacacgcaccttcccccaggattcaaatgggctttagcagacatggaaccaacccatatgcccaagaaaatgtggtacatatacaccatggaatactatgcagccataaaaaggaaggaaatcgtgtcctttccagagatatagatgaagctggaagccatcatcctcagcgaactaacaagggaaagagaaaaccaaacgctgcatgttctcactcataaatgggagttgaacattgagaacacatgggcacagggaggggaacaacgcacaccagggcctgctggggggtgggggttgaggggagggaacatagaggataggtcaataggtgcagcaaaccaccagggcacacatatacctatgtaacaaacttgtacactctgcacatgtatcttggaacttaaagttaagtaaataaataaataaacaaaactaatgggctttagcacctcttccctttttcttacttccattacacaagaaatgtgtccgataaattacaagattgtaaaaagggaagctggcttatgtgttactattccctcctctgccaacgccaagctgttttccccaatgagctatcattgttgtggttggatgttcagatggtcaactcataaagtctaacagcatttcattgagaaacctatttaatggtctgttgccatgggttagggaaattatcatcttattccctcaacgtttcattctcttattctaccactgtcaacagggaagtttccatcttactccctcaacacttcattccctgactctaccactgtcgatagagaaatttccatcttattatctcaatgtttcattctcttcttctaccactgtcaatggaggagagttttttcttttaactttgttctataagatgtccaggtacatttacagttattttgcattggctcaaatctggccattttatttttactaaaacatctccatggtggatatttcacaaacactaatttaatcagttgttctggggatggatgctaaaaagtagctattatattttgttgacgaactccaaatgattgttgactattaaaattgcagttgagcacctgtagttcatagcaactaacacttcggtccacacaaccctcgtgtgtataaaatgaaaccagtatattaaaagtctgtctggcaagccacatcaaaataggtttttaaaaagacgttgatatttttaacaggcaaaatctgcaggaactcttttattgcctcaaagtcgcaattctatcatctacatgacttataaaatggcacagatgttctgcttatttttattattcttaaatcgttgctgaagtctacttaaatcatcttcatatgtttaagtgtgtgtctcatgcattcacctcaacaatgtattaaagaaatgctatcaagggaatttctcaacaaactctaaagttgttcatgctgctcgttaatagaccttacagcagtggcagctgatggatatattgagataatcatcgaaaaagctgcgtttagcataactaaaactttttctctctattctgcccatctgcagctccataattctcgacagagctacacagaggaaatgcacatatgaagttaagtaaatgcacatacacacacgcaaaaccagatcaagacgcacgcactgacagtgggaaggttcgggaagaaagtggtacaaaccccaaattgattctttccacgtgtttagcaatgccagcgggcacggaagccagggatcggaacgtgcagtggacctcgctggggacgtagcaggcacaaggatgcgggcaggccagcgccactcgcggatggccccaaagcaggatcagcaccacggagagggccccccagtgcgcgcgcttgggcatcttgtcggggtgcctgattctcggatacctgaggtagaacaacgaagagatgagcttattcacaggtagcaccgacgaactgtgggcaatttttaaatttgaattgtgcatcagggtttcaagcttcccaggacttcacacgatgtgttgtagtgacgcttaaaccatgggaattgagaaagatgaaacatggttttttttctaaacttttcaccattcactttaatcatgactatagaatatagtcttgattcttggcttcgatactatgatttggaaatctatcttgcactctgtaattgcggctatgaaacagagagagacgagagagagagagagagagagagagagaagaaagaggtttatatttatgtatccataattaaaaaataataaaatattgtgtttctgcctccaacaagactgagccattatatattgcatatatttgaatttaaaacttcccaagaagtgtttattcgtattctttcctttaatgatatttttcaaacctttaattctagcttcttgaagagcttaaagaggtatttgctagaaggatattcatcctgttatttctgggtttatttactatccttatgtttttgtcttggaaaagccagagagtttttttgatgatatagagttgctgttaatcggggaggaagtttgggggaacctctgatcattcaataaacaggaagggactgcttatgaaatatattcaggcaaacagaaaaaaatggagtcactaaaaaatggaaaagctcgggtaaagctagattgcatcagctacttcatttagaatggcggtgatcattttcttcttgtcctggcaatgcctatgtcatctaacatttttgtcatctcttgaatggcgttcacttaaaaatagtgacacacatggaaagtaaatagggatacacaacaaacacgcgcctgcccattcgcccgggttctgaacgagcgcgaactgctgattaaaattctaaaacccaggccggactcggtggctcacgtctgtcatccaacactttgggaggccgaggcgggcggatcacctgaggtcaggagttcgagaccagcctgaccaacatggaaaaaccccgtctctactaaaaatacaaacaaacaaacaaacaaaacaaaattagctgggcgtggtggcgcatgcctataatctcagctgctcgggaggctgaggcaggagattcgcttgaatccgggaggcagaggttccggtgaaccgagatcgagccattgcaccccagcctgggcaacaagagcgaaactccgtctcaaaaaataaaaataaaattctaaaatccttcctataagagaggaacatcccaaacctgtagcttttcctgcctttaagtgacctagaaaaggttattctcttaagcccgggggcgcgtctcccttcagctgcccataaagaactgatggcgcacaggtagttttgcaaaaaagcaagtccgggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggccggcttccagagtccgctgggtcgcgtcgagctggctgcgggatgaattacgagctttcccggaacgcggctggggtggccctgcgagtccccgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcagagtgggcttcacttaggaattccgttggcagcttcctagaaacgcgggatggcggggttgaaggtctccagagagagccagggatggggagcgctttggggagagggaggaaaggaggcatgggatgtctgggcttaattagacctattcagtgcatcctccttcaagatccggctctcctccctatctgatccttagctacttaaaattgcaggaattcaggtatcctgatttcttagcaacttcaaacagtgctggggaacggtgcaatctgcctgcatgcaggccctttacccccagtgtttcccttgggtgtctcaaatcccttcaccccctgcaggcagacacggcagccctggggcgccctggccaccctgggtcctcacctgtccttgggaagccgccgcacacgggagcggtgcgccgggagcatccaccgagccggggcgcgcgagtcacggccgggagtttgccggggccatgcccttcccggggccgggggtgaggcagctcggcttcccagcgcggcacagcaagccggcgcccttttattcccggcgctgcgaggcttccccaagtccacgcctcggcacacccccaccctgccccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtccgcgcttggagagcgcctaagcagcgctgggaacgtttccgttcctttcaggagagagagaaggagcagggtttgcgcttctccgggccagacggtgttttctcggcagctcttcccagaccgtgtgcaagcaggagcgggctggccccgccggcatcccactagctgcaggcagggctgcaacgtgagagccgccgccacgccctcccgcctctccaggactccccggcgcccgcctccctccccttgccagagtcttcctgccagaaaggtggaacggctcccctccggcttggggagcattcgaggggcaaggcgagggttgggacgttcggagagtctgatggtattgtctggggagggggcggtgggagggtgggagcgacctggcgacaaggcaaaaagtagagggtgcagagggtaggtccctattccaggaggcagaggaagaggaggcggcggctgcctggcttcctggataagtcagacctggaatggtggggagaggtcaggcgagtatcttcagtcagcagagccaacctggggtaaaaacatggagctcagacaggtgtgtagggcccggaaaggcaccattgcaccagcttgttgtagggtgcaccagcgactgcttttcgctatacctctggttagccgtattcctctccctgaaccagcattttgacatgtccttagggtcagtgtttgcctgttgtgttctttgatctacaaaagacatctgtgagtataaaaaaaattttttttacaagcccagtggtaccatgtacttgtacaacgaatcctgtctgctgagatgcccctgaagcaggctgatggcgtgcggcatttatgtatgtgtgtatgtatgtatatatgtatctatgtatttgagacagagtctcgctctgttgcccaggctggagtgccagtggtgcgatctcggcttactgtaacctctgcctccgaggcgcaagcgattctccacctccgtcccccatgcagctggtactagaggcttgcgccaccacgctgggctaattttttttttttggtgcggacagggtctcactatgtt[135 bp omitted]attgagaagtgcctgctctttagattcagaagtcctgccctacgtccagcactctgtcagggggctttcaggaggaaggaaggactaagcctaagaaacaagttgcttcccctgcatgaagcgtggttcatcttagctcctcctaagaaacacagcgtctaggaattcctcaccacctgcctcctgcgcctagggtggcttccacagagttgatagtcaggaaatactggttcataaatgggaattcattccttctctagctttagttttcagtgtgtgttgacatagttccagggattagtcaaataatgcccttaggtagcctctttctgggcatgccccaaacccattgattaaatcacgaaacaaaacaaaacaaaaaacaactgtctcttgaacatctctttacccttgttaatgatgttgccacccatctcgtcagctaaactagaaactcaagccatccttgccttctgcctctccttcatgtcttcctcatagtcaactggttgccaagtttagatcctgatgcctaagaatctcttggcccaacgtgttcttctctccacctctctcactgcggttgcatggatatgtcttagattttgacaacttcttcctccaccaactccttctcattcatcccttccagcccatcactgagacttagagggatgccatcatcctcaaacccaaggctgaagttttccatgggtggcctgtgccatgccctgtgcttcccagcctgtccctgggatcttccttttggtgatagatctggcttgtcaagaacaagtagcacatccctgatttttgttgttgttggttcacgccactgttttgacaaagttctcctcaatctccattgtatagtatttccttacctccatgcccattgctaaagtgggcttttttcctgcattgtggacaatcactcaccttctttttatgccgtcatagcttcttgacacctggagtatagcacagagcttagcatacactaagcgttcaattgaatgaatgaatgaatgaatgtgcgc[137 bp omitted]ctggcaaaaccctatctctacaaaaaaaaaaaaaaaaaattagccaggcatagtggcatatgcctgtagttccagctacatactgggggctgacatgggagaattgcttgagcctgagaggcagagtttgcagtgagccaagttcgcaccactgcactccagccacagtgacagagcaagaccctgcctcaaaaaaaaaaaacatttaaaaaagtctggatttctctgcagtaaggaaatctgtttatactaccttatccagggggattattattggcacatttaatagataatatctatcaatacctctaaatacttgtgttacctgtacaatctgcaccccaaaaatgatttatcgaagtctagttaaaggcacaggtttacggaaatgagatggttaactcaaacataatggctttaattccttacaagtgtgaagtaaataaaatatcaagtcaactaattcaattctgctttgcaaatttcatgcatgggatgaaggggagtgagcagcggaaagagaccgctgaatgggagcagggttttagcttagggtgacagaaacgttttggaactacatgtaggtgatggttgcacaatattgaggatgtacgaaatgccatgacattgttactttaacatggtttactttacgatgtgaatttcacctcaataaattatttttaataacacacatactaataaaaataaatgcctagattagaaaagtcccagggcgtaacttgtacaataaatccacaaataaagcattatggaatctcgtcattctgtactttttttaaataaaatgcatagtttgctgcatttagtcttttttgttttgatgtttgtcctgctaatgttgcctgcttgcttggtgatgtgttcccagagcagggaccatgtttgattaattgttgaatcccttgaagtgccaagagagttccttaaatacaagaggtttggagtacatgtcggttaaattaaattcatctgcttgctaataattccaccatgtggagggtgaggagggatgatcaaatgaagggcaggtcagtccttgtagctacagaatgtacttcaagcaaaagctcagtgattaacaaaaggccggagccctcctaatcgccagatgccatggaacctgaaggattgcagcttgttgcaggatgcaccagtgacttttaccagccactgcttttcactgttcctctggttagcagcatttctcttcctgaaccagcattttgacaacatgtccttattatcaacatttgcctgttttgtctttgatctacaaaagacatctgtgaatatatatatatatatatatatatatatatatataaaatagagcattcagaaggaaatccaaacaggtttgctagctcacttcccatcacgcaaccctgatcctccatcgagaccccctttcctctagaaatgtggaggtagggaaacttgcagcccaggagacccaggaggcccttaccactggggagccatcatccctctgcctccgtcataagatctttaaaatccacttttcttgcaaggctttaaccaacagcagagccataggtgatcgagtcagacagatagtagagctcaaaccacctcctcctactactcgctatttcttggccagagggcctagaacacactattctcccttcctaaaaccagatttctcaagggtacaataagggtaattttacctcttggaggtggcgtaaagacagaatgcaatgctgtatagagagaactgaacatactacctgcaccacatctgtagttaatatttatatataggatccagcgaatctacagtcatttttttcagctttattgctgtgtcttttatcttcctatccaggttttaccccagcgcagagtctctggaggtgcactggctgttttgtgtatgaactgcagttcctggcgattctgatttcaatgtgaaagtctaatattctaaaggactctgtggatcactatgtaattttcttaacaagggttgtaaaagtaactttcttagtcacatgactgcaaaccccactgcttcccaaactctgtaatcacgagaagggctgacctagtgaatacccttggatgactggagggaaaaaaaaaaatcgacacaggaaatctctacttcaaactcatgggcttgcatagctcagaaatctcaggggcagactaatagctagtggggttgtatctttatttgagcagaaacagacttttaggaattttccatgggaacttgccctcatctgtgtagggtaaaccttcaatgaaaatacgggctactggccacctcaatgaaaatgagggggtatttttgttttgcttcttatcctcatagcacagtcggtaggaatactctgttctcttgcatgtactaaaatgcttccaaattttctcaacagcatactttaaaatagaacagcagcgtggaaaataagtaaataaatacaaagaacacgtcagagaaaccctctagctctcctgagcacagttgagttatctctgcagattaggctggagaaaattctgcttagcatggtgcatatcaacctacagagaaaacacatcgtggagaagtgaactagcctgacccagcttgggcagatgtgctgatggggatttctcggcaaaatgaaagctgtttatctactactgtgtcttaccgggaccagcggcacctagaacggtggaactcacagacacaggcttctccgctctggatccctaaaatttcagtcggtagaaaacagctgcagaagatgagatcatggaaggttatccccttcctccccaacccagaccacacaggccagtgaattgcagacagggaaaggcaagggaatgtcagcaattattaatgaatcccttcaaagacctcaatcctggatgggtcattcagcagaaatcgcagaaatcgagacctagctcacttttttgtggggggatgaagtctcactctgttgtccaggctggagtgcagtgatggaatcctggcacgctgcagcctccacctcccgggttcaagcgattctcctgcctcagactcccgagtagctggcactgcaggtgcgcaccaccacgccttgctaatttttgtatttttagtagagatggggtttcaccatgttggccaggctgatctcaaattcctgacctcaggtcatccatccatctcgccctcccaaagtgctggggttataggcatgagccaccacactcggcccatctcacttttcaaaataaaaatggcacattttcaacatgaaactattcatttcagaaagatgttctataaatgatgaatactcacgattctggagttcacatcaagagggaaccctaatgaaaactacggactttgggtgacttcgatgtctccgtgtgagttcatctgttgtaacaaatgtctcactctgctgagagctattgatcatggaagagggggtgtgtgtgtgtgtaggaaagggatatataaaaatttctgtgccttctgctcaattttgcagctcagactgctctaaaaataaagtctagttttaaaaattctatatttaaagagtcaagactcttttttttcctcccatctgttttggcttacatttttgctgacttgtcttctttcagacaagcggcctcttggaataaaaaccaaatggcttctaggggattccacatggaagctgccctagaagcttgtgaggaagaaggaaagaatgtcactgaaactagttctgagcactactggctggtggagaccttgccctcaagtggcatggtctagaaatctcctagggcagcggtccctgatctttttggcaccagggaccaatttcatggaagacagtttttccgtagagcaggatgggggtgggacatatggttttgggatgattcaagcacattacatttattgtgcactttatttatattattattctactgtaatatataatgaaataattctacaactcaccatgatgtagaatctatgggagccccatgcttgttctgtgcagctagacagtcccatctgggggtgatgggagagacagtgacaaatcatcaggcattagattctcataaggagcctgcagcctagatccctcgtatgtgcagctcacaatagggtttctgctccagtaagaatctaatgctgctgctgatctgacaggaggtagagctcaggatgggaagcagctgtaaatacagatgaagcctcactcactggcctgctgctcacctcctgctgtgcaacctggtttctaacaggctggtagcagtccatggcccatgaggttgcaaacccctgtcctacgacattgttcttacatgtggatggattccaagatccatctcacttttcaaaataaaaatggcaaatggtctctccttcagcatgaaactattaatttcagaaagacctcctataggtgatgaatactcaaaattctataggacaccacgtgaagtgctttccctttgggtaagatgtctctttcatgaattagaagaagccgccttagttaacagacccggggtgactcatggaacaagttttaagttattcttaaaatacagaagaggaaattagtacttaaacacagtgacctttgattccctgcataatcatgagattgaaacatactgagatttactcgattataaatataggtgtgtgtttgtaagtggacaagcttagagattcactaaaactcaaactaaattcaaaggagcactaatgtattttaaagaagtatcaaaacactttggaacacgctctttaaagatataaatataactctcttatgaataaagtgaaagaaacaaataactcaaagccgttagaaagcctggatgagaaaattcggcttctaaatgttgccctgaataccttacaaagaagaaaaaggcaaagaaaatatctagcttaaacagaaactgtggttttgtaatgattcctaattagccttcaaacgtgggcacaatctgtatgcatttcccaggactgccgcacaaatcgccactaactgagtgtcttaaaacaacagaaatttatgctctcccagttctggaggccagaagtctgagatcaaggtgtgggcagggctgcactctctctggaggctctaggggagggtccttcctgcctctcccagctcctgggggctccaggcattcctgagcttgtggccgcatcactccagtctctgcctctgtctccacgtggccttctcctttgtgtgtgtaccatctcctcttccgtctcttagaaggacacctgtaattgcatttacggttgactctactccaggatgatctcatctcaagatccttaactaaatgtttttacatcctctttcccagaagctatgaaaattttaccttatagggcaataggggaatcaaagttggagggaaaatgaagtttgcccatcagctgatcctaaaatgaggagattattctgggttatccaagtggaccccatgtaattgcaagggctcttaaaagtagaagagggaggaagaaatggaggttagaatgatgagatgtgagacggtctctgctggttgttgctggttttgaagatgaaggaagaaaccacatgccgaggaatgcaggcagcctctgggaggtaaaaattgcaaggaaatggattctttcctgcatcctccagaaggaaccaacctggccgacactttgattttagccccaggagactcatttaggacttctgatttctagaactgcagacgaataaatgtgtgttgttttcacccagcatttttggtatttgttttagcagccacaggaaactcatacagagctcttgcacagggtctaccatctgttcttataattgatgcgtgatttgtgagctgactccctggacaggcatgtggttgctgaagggaagatttgacacttcttaaattaccaaatccactactcctctggtaaggaactagaggaaagaagcaagaaccaacacatgaaggtaagttttgctttgtttttattattatgttatattgtatttttattacaagggagagtattttacccatgggcttttattttgaaaattattagatatgattaattattaatatcatctttaataattattaatatcatctttaataatattataattattaattattaatatcatctttaataatattataattattaattattaatatctaataatataatattatcttatctaatgatattagataagactaaattattataagataattgtttatgatcagtctttcctcatttatttctcaggcataaccattgtaaagataggcataagtatgaatgttattcattcattatgtaaaatattttaaatggcacacatccatatgtattaatacacgattcactatatataaaaattcagagaagttaaaagaaattcctaaagaccactttgtgtttttaagactctggaagaagagattgggggtagacaaaaagacttagtattgaattttttttcttttttttttactctacgcatttttggttttatacccaaaagggggatttgtttggtttagaaagaatgtcttctgatttttatgtttaaaaggaccactggatgttttattgccttgacatttaaacttaaagccattaaggaatatgaggttaacctagttaaactcctaaaagacccaagtcacgtagtgcttttcatctcctggtttttctttttttcttcttttactctgaaataatctttttttggcaggggatggagtcttgctctattgcccaggctggagtgcagtggtgcgatcttggctcactgcaacctccgcctcccgggtgcaagctattctcctgcctcagcctcccaagtagctaggattataggcacacatcaccatgcctggctaatttttgtatttttattagagacggga[140 bp omitted]aataaaatgtgtctgaagtttagtaattccatgagtttcgctttctattttggggtaaaactctcatataacataaaatggactattttaatcattttaaagtatgattcagtggcatttggtgcagtggtccccaacctttttgtcaccagggactggtttagtggaagacaattgttccacggatggtggtggtggggttgaggaggttggttccaggataattcgagtacattacatttactatgcactttattcctattattattccattgtaatatataaggaaataattctacaactcaccataatgtggaataggtgggagccctgagcttgttttcctgcaactagacagtcccatctgggggtgatgggagacagtgacagatcatcaagcattagattctcataaggagtctgcagcctagatccctcgtatgtgcagttcacgatagggtttctgctccagtaagaatctaatgctgctgctgatctgacaggaggtggggctcaggtggtagtgtgagccacggggagcagctgtaaatacgcatgaagcttcgctcactcacctgcctctcacctcctgctgtgtggcctggttcctaataagccatggacaggagccagtccatggcctaggggttaaaaacccctgatatagtgcattcacaatattgtgcaattatcatcactatctagttcctaaacattttaaacatcccaaaaggaaaccctatatccattaagcagtcactctccattctccttttctcctagttcctggaaactgcttattttctgttttctgtccatagatttagctattcttgaaatttaatataaatggaatgatataagtggtcttttgtgcctggcttcttttactgagcatggtgttttcaaggttcacatatatagtagtctgtattagaccttcattccatttcatgaatgaatcatattagactgtaggaattgaacatattgaacatattttgtttattccttgatccttggatggataggtaaaattatatgtaattatatgtaacgcttttttttttttttttgagacagagtctcactctgttgcccaggctggagtgcaatggtgccatctcggctcactgcaacctccacctcccaggctcaagcgattctcctgcgtc[135 bp omitted]cagcctcccaaagtgctgggattacaggcatgagccaccacacccagcctgtaatgctttttagaaaagaaccaaatacatcagcattcattttcgatctagtgaaataggcacagaatctgcacatcatgaaatgagcacccattaatatgacgtgcagaacatctgaaagccaccgtgaaactacacttcccatgtttctccaggggtgttatgatagaaaccttatatagacaatatttgcaaggcaagcacagacttcttatttacgaactctcagcatactctatttttttcttaatgagtaaacttatctatccatcctccatatatccatctatatttctatcaacctatagattgtctatgtatacctatgtgtctaacctctgtcagttgtctaatttatcacctattgattgtttatcctatatcttaggggtccccaacccccaggccatggactggtaccagtcggtggcctgttgggaactggcatacacagcaggaagtgagcagcaggtgagagagcgaagcttcatctgtattgacagctgctccccatcgcttgcattactgcttgagctccacctcctgtcagattagcggccccattagattctcacaggagaaagaaccctattgtgaactgtacatgtgagggatctagagtttgctgcgtgctccttatgagaatctaatgcctgatgatctgtcactgtctcccatcacccccagatgggaccatctagttgcaggaaaacaagctcagggctccactgattctacaagatggtgagttgtataattatctcattatgtattataatgtaatcataatagaaataaagtatacaataaatgcgatgcccttgaatcatcctaaaaccaccttcccaccaagtccatggaaaaattgtcttccgtgaaactggttcctcatgccaaaaaggttgaggactgctggtctatccatcatctaccatctctattgtctatctttctatctattttctatctttatatccacctacctatacttgagataagtttaaacattcattttttattagtttcattaaaaatatagccttcttcaaaggttagcttagaatcatgtttgatcatttttttccttccatagaataaaatgcagttgtaataaaatacagtctaaattctttaaaaagtgactttattgtaatcctttcgtttattttttttcccttggcaagtgtgtaagattttcctaaaacactatataaactttttgcatgtacgtatgtctggtttttgttattgttgttgtttgtgctgcagtgtggctaatcaaagaacaaaaatatttgtttcattctcatcatgcaggctttatataattcttgggacttaattgatgagtgacatattggagatgtctagaaaaatggtgatttccagctctttcttttagtcaatccttcaaagtccgtacattctcctgtttcctaaggggcagggtgttaagaaaaataaaaaacttgacttgaaagtgcttgtacaatttaaatactgtgtttgtttggcagaaatagtgttttaacaagagcaccatttgtttctccctcatttataggaattctcgagatggaaaacccagggatgaagttctgggatgccggcaccttcttcccttagcatgtggactcccacgtttaacaaaagctgctgaccaggagcggtgactcacgcctgtcatcccagcacttcaggaagccaacacaggcagatcagttgaggtcaggagttcgagaccagcctggccaacatggcgaaattccatctctactaaaaatacaaaaattagccaggcatggtggcacatgcctataatcccagctagtcaggaggctgaggcagaagaattgcttgaacccaagaggtggcggttgcagtgagcccagatcgtgccactgcactccagcctggacagagccagactccatctcaaaaaaaaaaaaaaagacaaaagctgctgactcttcagccaccccatctgtattccagacataaatcaggagaacaggaggaaggaagaaaaacaaacaaaacaagaccccctccaggagctcccagcaccactgaacttacaaagtgtcaattggaagaatctttagaaaagaatagatttttctgttgagcatattgcatagtgtgtgggtatgtgagtgtttttcccctacagctgctgtaaccaattaccacacatttagtggattataacaacacaaatgtattatcttatagttctggagctcagaagtccaaaattaaggtgctggcaagactgtgttccttctggaggctcttgggtgaaatccgtggtccctttctgtatgttcaaagccagctgcctagtgtcttccaatctttctctttctgaccctcctccttccctcttctacggaccctgtgattacatcagggtgcacctggacaacccaggctcatctccccatctcaggatgtttaacttaattataagcttgctgcaaaagtaattgcagtttttgccgttaatattaggttggtgccaaagtaatcgtggtttttgccattatttttgcaccaacctaatacatctgcaaagtcatttgtttccacatgaaataacatattgatgggctccagggattaggatgtggacatctctgggcacctgtatgcagcctgttacactcagtgaagaagtaagggaaaatgagtgtcacgtaggtatctgactatctcagccacagtgaaaggggaaaagttccctcatctccctcacaggacgtgcgatgggggtgtggctcactccttcagtgccccactgcgcaaacccctcggaggtgcaggcagaccgggaggttgtggggctccgacccctcggcagcatctaggggtgaatgtttatagctcctgaagccccagtgggcgtgtgttacagagtgctcttttagtttagccacccataagcggcttgtgttactcagctcaattagaccccctaccttatcacaaagatggagggctttctgtatccctggtttcttgtctttgtgtaccggaagaatcagatcacacatgggcttggagaatgagtacaaggttttattgagtggaggtagctctcagcagatgggggagccagaagggagatggttttcccctggagttgccggccgctcagcaatccaggctttcctctgaccttccccgccaaaatccgtgtagttctgctggtcaatggcccgccggcccgctgccgtccgccgctgcactcttccgctggcgtgctcccctccaggtccggctgcttgtgtcttcttctgctgatgtgttcctctcaatgtccaggcacttgtgtgtctgcctgctaggtctcgaggtttttataagcacagattgggggcatagcaggccagagtggtcttgggaaatgcaacatttgggcaggaaaacaggagtgcctgtcctcacttaggtccgtgggcacaggcccacaggtggagccctagccagggaccacaccctcctctacccagcacttccctgccccccttccatatgaatagtgctgtaaatgaaaaagtagatgactgatttttatgtagattcatggagctacaagtacactcagcctagacctatctgtaatctctttgtgcataccaaattttatggtagatcttaacatgtaagcactttcgttggtttgtttttgagacagaatctcgctctgtcgcccaggctgcagtgcggtggcatgatctcggctcactgcaacctccgcctcccgggttcaagtggttcttctgcctcagcctcccaagtacctgggattacaggcgtgcaccaccacacctggctatggggttttgccatgttgaccaggctggtcttgaactcctgacctcaggtgatccgcttgcctcagtctgccaaagtgctgggattacaggtgtgagccaccccgcctggcctcatgtgagcattttaattgccactaaaagatatgatgggctgtgattttgtttcatggtaaagtgagccacacagcaaagtacatttaaacacgctgtagcaagataactattcacataccatgagatttcatcctacaccagtcagaatgactactattaaaaaaacaaacaaacagatgttggtgaggatgcagagaaaagggaacacttacacactgttcatgggaatgtagattagtacaatttgatgaaaaagggtgtggagatttctcaaaggaccaaaaatagaactatcattcaatccagcaacccactactggatatctacccaaaggaaaagaaatcattatatcaaaaagatacttgcactggctgggcggggtggctcatgcctgtaatcccagcactttgggaggctgaggcaggtggatcactagaggtcaggagttcgagaccagcctggccaacatggtgaaacactgtctctaataaaaatacaaaaactagccagtcgtggtggcgcacgcctgtatccccagctactcaggaggctgaggcaggagaattgcttgaacctgggaggcagaggttgcagtgagccaagatggcacctctgcactgcagcctggaagacagagcgagactccacctcaaaatgaaaagaaaagatacctgtactggaagccctatttacaatagcaaagatatggaatcaacctaagtgtccatcaatggatgatgggataaagaaaatgtggtatatgtacatactggaacactattcagccacaaaaaggaatgcaaccatgtcttttgcagcaacatgaatggaagtggtggtcattttcttaagtaaaacaactcagaaacaaaaagacaaatactacgtgttctcacttataagtgggagctaaataatgtttccaaataggcgtagagtgtggaataatagacattgctgaccgggaagggtaggagggggctgagggataagaagttacttaatgggcacaatattcattatgccagtgatggacacttcaccactgcacaatctatctaggttacaaaatcacacttataccccataaattaatacaaatttttttaaaaaccaattacactgcttctaaaagtcataatttaaaaagtcaagcgatagaaaatgcatttgttgatttaatcatttgtctagttaataaatcacacaatgtctagtgtattgatgtagattgaactccacatgggcctaaattgtgttaatcccacttgctgaattctttactcaggcagggaggtcagaatgggaactcctggctacactccacatctcagcagggaacagcatgtgccgtcttgcctgtctgctcctgcagatcagtagcaacctgtctgaagtgcaaatagagaaccagtctggggatgtgtctgggctaagcagagaaaatcacttcgagaaatcactgatgtctgccaagggctgggagaaaggaggacaccggggcattcaattggcacacctgccctcatcagtccgaatgctatttcagtgcaaacttttattgcattgtgtcttagtccatttcacgctgctgataaagacatatctgagactgggaagaaaaagaggtttcattggacttacagttccatattgctggagaggcctcagaatcatggcagcaggtgaaaggcacttcttacatggcgacagcaagagaaaatgaggaagatgcaaaagcggaaacccctcataaaaccatcagatctcatgagacccacccactaccatgagaacagtatgggggaaaccgcccccatgattcaaattatctcccactgggtccctcccacaacacatgggaattacaagagtacaattcaagatgagatttgggtggggacacagccaaaccatatcacattggtaacatgcttgcctgtgtagttttaggaatgtgcttctccagcctactaaaacctaattttaacatagactatctcatttcaatttttaaagatttttctaacagcttttttggggaaaaaagatttataccagtttatttactgaaacgaagataatagatttgtttgtaaatatctcctaattatgcaatatggaaacttcaaaggaaagtgagcgtctgtttgttgttgttgttttgttttgtttcgtttttgagatagggtctcaatctgtcacccaggctggagtgcagtggtgcgattgtggctcactgtagccttgacctcctgggctcaggtaatcctcctgcctcaacctcctgagtagctggggctgcaggtgtgcaccaccatgcccagctaacatttatattttttgtagagacgaggtctcattgtgttgcccaggctggtctcaaactcctggactcgagcgatcctcctgccttggcctactaaagttctgggattacaggcgtgagccactacgcctagcctccatttttaacatcttataacgcctagaagagatcacttgatttccaggcacatcgtgttctatcactggtttcttcaaaatttattagagcaattttgtcttgtgtatatttgttaataattgtatcacaaatgatttaatattgtaattattataatatttattgttaaaaatgcaaataatatatattatataagtatatgtgtctttaagtatattttataagttatataggtgtataagatatattataaaattatatcatattcatgaaatacacactatattatattatatataatatattgcatataagttacacgtggtggctcatgcctgtaatcccagcactttgggaggccaacgcaggtggatcataaggtcaggagatcgaaaccatcctggtcaacatgatgaaaccccatctctactaaaaatacaaaaattagccgggcgtggtgcggctactcgggaaccagaggcaagagaattgcttgaactcaggaggcggaggttgcagtaagctgagatctcgccactgcactccagcctgggcgacgcagtgagactctgtctcaaaaaaaaaagttacatatgaatatataacttgcatcataacataaatatctttctgtaatatgtaatatctatgttattgatgatatattcattctattatataatatattcatatattatatttatatatttgtatattatatattatacattcatttaaatatatctaatgtttatctaatcaagttatctaattatctaacttaaaaacatctaaataaaatttatattttatagtattatagcaatacatttaaatgtatcagcatcaatatatagtgtattatgaaatatttatgtattacaataaattcatatttattcaaacatgtatacatttaagttatgcacttaaatatgtatgaatatcttatgcagatttcaatattaattagataagcatgcaaacatattttccctttgcctttagggagttcattattctgtataagctttccttctttttcaactggaaaaagcataaataaacttgagttaaaatctaaatgtttgatctgtttattccaacatttcttacacttagtttatctgtctatggctcatacgacttacatggattgcttgaaagagttattggtagggttatggtaggtttattggggtaggggtttaagcagaattaaatgtaggaaactgagttccccctagaagcacaagcagagactaggatttgagggtaaggtgtttatggggcggtgataccaggaaggacccatcggagaaccagaaaatgagacagtggaggccccattccagaaaccttcattgagctaatccgagcgtttgacctggggctgcacatttttggcgaacacccgagttgtttctgaagcaagtagaatacggatcgtgcatctcccagaggatactctgatttgaaggaatctcctgtttacactggctcattggcttttttgagtgataaccctgacggggcccatgacaggtcaatttcaccttgagaaagagtagttcagggacactggctcttttgttaaccttcctagttactcacaagggtgcccaatggctcacaggtgagaagaccaaggtacagcgggggggggtcggcagtcaattcctaccactagaaatgactcacgttgtggcccagtaattcctgatgtacagtgcattattactggataaatggctgcctcctgggaagatagagagttcacaggccctcacccatttgccaacttattaattttctgtggctgttgtcacaaattgctataaacttagttgcttaaatgatgcaaatttattttcttacacttctacagttcagtaattctggaggtgagaagttcaacaagagcttcattgggctaaaatcaagatgtcggtaggctcagcgtcacgcaatgtaacaatgtaataaacctgcacatgtaacccttaatcacaagtacaagttggcagttattttaaaaaataaaaaccttcaccaagaatgaaaaatccttgtgaatttccttctggaatctcttttgaacagatgtatggtgtattcattttttaaacctgatctttggtctggtacaaatgttgatttttttcctaatttttacattaaatcattccttaaagtggttataattataaaagtgaaaaaaaaaacaatagcaaaaaggtgtcagtagggctgcattctattagagaagatgttgggcagaattcatttccttgcttttcaaggatggtggcagaattgtttcttgtggttgtagaatcgaggtctccctttctggctggctataaactgaacatcatttccagcttccagagaccaccatactcatctctcttcgactctggctcatgtctgccatggaatcttgtctccccctgatagcccagaactgccccaaatgctgaccaattttgacacacagagttctcaataggctcagctcctcagctgataggcactgaatccaagcacatctgacagccacaccaaggccatggtgctccaaaggagcattcaaagctctttcagtgtacactaccacactctccacccagtgtctgagcatggctcacgggcctggggcccgtgttgacccaaactcttggtcagtgtgctaacccacctgatatttctcattgattttgatgttgcctctaacctgaagggtattagtttggtacacttgctgtaaaaaattacctcctcttgctctatcacctgcctcaggtgcccggggtcctagtggttcactgcactgtgaagacagattccagatgcagggaactcacacctccaatcccagacgctgtgtccagcaaaggctccatggttctggcccacagtggtggcctggacacctcctgcatcctcatgtggctgaaggaacaaggccatgatgtcattgcctacctggccaaaatcagccagaaggaagacttcgaggatgacaggaagaaggcatggaagcttggggccaaaaaggtgttcattgatgatgtcagcagggactttgtggaggagttcatctggccagccatccagtccagcatcctgtatgaggactactacctcctgggcacctctctggctaggccctgcatcgcccacaaacaagtggaaatcacccagcaggaggggaccaagtatgtatcctacggcgtcatgggaaaggggaacgatcatgtcctgtttgagctcacctgctcactggccctcagattaaggtcattgcttcctggaggatgcccgagttttacagctggttcaagggccttaatgatctcatggaatacgcaaagcaacatcggattcccatcccagtcactctcaagaacccgtggagcatagacgagaacctcatgcatatcagctacgaggctggaattctggagaaacccaagtaccataagcacctccaggtctctacatgaagactaaggacctcaccaaagcccccaacaccactgacattctcgagattgagtccaaaaaaggggtccctgtgaaggtgaccaacgtcaaggatggcgccacccaccagacctcctaggagctcttcatgtacctgaaccaagctgcaagcaagcatggcctgggccatattgacatcgtggagaaccatttcattacaatgaagtcctgaggcatctatgagaccccagcaggcaccatcctttaccatgctcattcacacatccaggccttcaccatggatcgggaagtgcgcaaaatcaaataaggcctgggcttgaaatttgctgagctgctgtacaccggtttctggcacagccctgagtgtgaatttgtccgccactacatcgtcaagtcccaggagctagtggaagggaaagtgcaggtgtccgtcttcaagggccaggtatacatcctcggacaggagtccccactgcctctctacaacgaggagctggtgagcatgagtgtgcagggcgattaggagccagttgatgccaccgggttcatcaccatcagttcccttaggctgaaggaatatcatcatctccagagcaacgtcactgccaaatggacccctatacaagtgggagctggggcctcctcactttgcagatcccccaagtacaggcactaattgttgtgataatttgtaattgtgacttgttttcccagctggcagcgtagtgggcctgccaggccctagctttgttccctggtccccctgaagcctgcaaaaatagtcatcaaagggaagggtggggggcagctgcagtggggagctataaaatgacattttttttttgagacaggttctgactctgtcacccaggctggagtgcagtggctcgatctcggctcactgcaaccttcacctcccgggttcaagtgattctcatccctcatccctcattctcattctcatccctcagtagctgggattacaggtgcacaccaccatgcctggctaatttttgtatttttagtagaggccagctttcaccatgttggccaggctggtcacgaactcctgacctcaggtgatctgcccacctcggcctcccagagtactggccttacaggcgtaagtcaacacacctggccagaaatgacaattaaaagaagattaaaaaaaaaatgacctcctactgggtggctgaaagcaacataaatgtattatctcccagttctgtttttttcaaaattcgttaatttttgtgggtacataggaggtgtatatgtttatgggatatctgcaatgttttgatacaggcatgcaatacataacaatcacatcacagagaatggggtatccagcctctcaagcatttaccctttgtgttgccaataatccaattatactcttttagttatttttaaatgtaaaagtaagtcatttttgatctcctagttctcttcttggcctctccctagcttccagtagccactggcaatccttggcattcctggacctgtggctgcatcactgcagtccctgtctccatctccatgtggccttctcctctgtgtctgtgtatcctcttccgtctcctagaaggacacctgccattgcatttagggcccaacctaatccaggatgatctcattttgagatccttgacttaggtatatctgcaaagaccctatttgcaaatgaggtcccattcacaggatccgggcattaggacatagatatatctttccaagaccacagtttaagccactacaggtgtccttagttccctctggaggctctaggggagggtccttcctgcctctcccagctcctgggggctccaggcatccctgggcttgtggctgcatcaatccagtctctgcctctgtctccacatggccttcacctctgtatctgtatctcctcttctgtctcttacaagtacacctgtcattgcatttagggtactgaatccagcatgacttcatcttgacatcccgtactaattacatttacaaagactcaatttccaaataaggtcctatttcaaaatttcgagcagacatggaattttttttagtggggaaggtggggagaagacacagaatacctgttgtgttccccgcatcctctggctcccgctgttttctcctagccagtgggatcctggtctctcacatctagccattacctggaatcttgcctgcagggagctaccccaaccccctgccctgactggctctgattgggttatgtattccccgtctaattgtatcaccacaattatcacaacgtatatctcatgatcatcatccccagtttagggactttaccttccaccatcctttcattaaaatggtttattaaggtgcttactgcaagttagactatgtaagtggatacattttaaaaataactgaattgaacaacataatttgacctcctactctctgtttgtcctagaaaaaagcagtaagtacacatgaattagagtcttaaaatatgagagcttttcaggttgggcgcggtggctgacgcctgtgatcccaacacttggggaggccaaggcaggaggagcacttgagcccaggatttcaagaccaggtgggcaacatgatgagacccctgtctctacaaaaaatacaaaaaaattagctggtgtggtagcacgcacctgtagttccagctactcaggaggctaaggtgggaggatcacttgagctcaggaggtggaggctgcagtgagctataatcagacaactgcattccagcctgggcaatagagcaagaccctgcctcaaaataaaataaagtaaaataaaataaaataaaatatgaattgaacaacgtaatttgatctcctgccctgtgtccatcctagaaaaaagcactaggtgcccttgaattcgaatcttaaaatatgagacctttgttctaaatgaaccacccacaatctccacacctgttgtgaagaagtaactaaaatgcccggattttgtttacttagcagaatcccctatatccctaagtgactcatagcctgttgctgttatgtaacagcttgctagagagactaaacatttcaggattgttaagggaacaaaatgcaagtaaggtgttcctacagaaacgttgcccctggctatgaacacctatgagacacttggaaaatgatgtcattttgttttgttttgtgggaagacagatacactgcatattgtccacatatggaaaccatagtctgagtatataacctgggtggccaaattagttgcaaacaaagatacagtagcaataatagagtgtaaccctgatagaaaggagaatgaacagatccacaataggtcagaagatctgaagttgcatccacctttattcattaggaagcctacaaaaagcaggaaacagtagctaatgtgcttaattcatgtttaaagagtaattgaagtaacaggtatcagtgtgttttcaaaagaaataaaattcaatggctgcagtttcctatctggttatataattcccatgtagttgtatcacccaattgatgactaagttaaacccacaacacccttgccaaggcctgcccagcctccagcgataggcagtgatatttcaattcgtttaggggtaggtctgttccacattccaccagctctattgtgtgggttttccttttagggagacaaaaatccacctctaggtaagtttcatggatcacaggtacaccgctagggaccctgtagaatgtctgtgatacttcgactacacagcagcccttcaaatcttaaatggcacacgcacaaaaataatcatgcttcctgtgtcttaatttggtttagaataaatatgcactcatgcattgttgaggttaagagtctgctatggtctgcatgtctatgtcccaccccaaattcatatactgaaatcctcaccaaaaggtgatggtattgggaggcatggcctttgggaggtgatgaggtcataaggtagagcctcatgagtggaatcagtgcccttagaaaaagggccccagaaagttctctcgccccttccaccatgtaaggacacagcgagaaggctccatcttaatccaggaagcaggtcctaacaagacactgaatctgccccgccttgaccttggactcccagcctccagaaatgtgagcaggaaatgtctgctgtttgtgagccccccaggctatggtattttgctagagaagtctgagtagactagaatacgttccttacaccaactttcgcttttctatatttcctcaaattcaagcactcagtgccaggagtatctggatgagaccaggttgcgaatccttactagacactgaatctgccattccttgatattagactcccagccccaggactatgggaaatcaatgtctgctgtttataagccatgcaatctaaggtattttgttacagaagtctgaattgactgggatacagtttcttatagcagcattcactctactatatgccttcaaaatggagcactcagcactgtgggtatccagggagaccaggttgggatgactgttggtgcctacacttcagctgattggagctgaatatcacagcacattgtttgatttagacaggtatttgtcagtcttggtttacattcaaccagttgtagacattcctaaaagtttttcaagccactctttcatctctgctcatcaggtatggtgtggagaggttcagaacacctgccttatccaggtgggtctgctatcatcacagggatccttacaaaagggaagtgggagagtcaaagctacagaaaagacacaggctgcaggctgcaggttggcttgatataatttgaagatataggaagcagtcatgagccaaggaatgtagacagcctctagaagctggaaacagaaagaaatcgtttttctcctaaaatactcaaaacacagctctgcagacatctttattttattctgatgtccaaaagtgtaacagaataaatgggtgttgttttaagcaatgacatgggtgataatttgtgacagcagccacagacttgcacactcatcgtcctgctggtcaaccttccctacaagagaaatgcaccccaggtcctttgcacctgctggcccctctgcttggaagcttctttctccaaatgctgaatgatttattccaacaccacctcctccgagtggcttttcatctgtccctttccaaaataatcttctcctttccttttgccctgattcacttttggaaacagttcctatgtgagtttagagtttattttactgcatttgattctctcactagaatgtgagctcaatggaagcttcagcgttctcacccatgaccctgtctagggttagggttagggttaggcaatctggagccatcaatagctattgaatgaacaagcatggccaggtctatgtttagagggtcaacttctggacagggacataatatcttcttaagcagcgaggaagtcagcaagagccatatatctgccatagggaaagagtagaagcacacatattgcaagtggaaatcagagttaggggacactccatgggtctctctgattctgagacacccgactgcatggtgagatattgtattagtccattttcacactgctgataaagacatacctgagactgggaaatttataaaagaaagaggtttaatggacttacagttccacttggctggggaggcctcagaatcatggcagaaagcaaggaagagcaagtcacgtcttacatggatggcagcaggcaaagcgagagcttgtgcagggaaactcccctttataaaaccatcagatcttatgagatttattcactatcacaagaacagcataagaaagacctgcccccatgattcaattacctcccaccaggcccctcccacaacacgtgggaattcaagatgagatttgggtggggacacaaccaaaccatatcagacttcttccataagtggttttggctccagacacacagtgaagtcacctgtgatgaccattaagctgactttggaagtcacctgtgagcttccaaaaacacctgcgcctatggttctaactacatagatttgacttcactggacctggatgtagtctgaattctgggagtgcaaatgttcttcttgtgagtctaacaacctctaaatggatatgataatgcctagatcccaagacagaaacaaatgtatagtgagcatcaaactggtttgggatgtgggaggcagaggatgccatgggtcagggaaaatgggagatcctgaatttgccaatctttcttataaagaaggttatattttcctcagaagagtaaatcaaacccaattttaaacttgatttagacaaaacatgtgtctgcacatgggtgtctatcccttaaggatgtaagagttgttgtactatccatctatatttatgacatatagttctctacagggagaaaaatgctgtaattttcttttatttgaggccaactctgttttttggccatgtgttcagccataagtggaactggctgacttttaattttccacgagtatcataaagaatagaaatggaaagtaataaagagaaagtgattgagtgggcaatattttccttttagctcccaaagagaatggccaatatttttcaaccctaaggaatgcctgtcatttattctcagaagcaatgtaggaattcatgggctacctcaagagatgccatgagaacaaaagtgtagacccaaaacaaaggtagctagtgtcagcacgtgatgtatgatgcaatttgaagaccagggagaatttgaagggataaaaggagggacattgtgtctcacaatagaatcacgtaagggaaaagatgtgcagtgtgccaagtgagtgttttccaattggcagtagacaacaactcttctactgagaaatagtatggggggaaggagaaagagaaggctagagatatgttgcctctctattggaacaactctttgaaaaatgtgtatagaaaacttctaagtgtcccaagaccacagacatataggatgtagatttggccatggacctttggcaatggaacatttgtactcccagaatccagactacacccaggaccaatgaagtccaatccctataggcagaaccattggtgcaggtgtttctggatgctcacaggtgacttccaaagtaaacttaaaggccatcacaggtaactggggcccagaccactcaaggaaggaggctcacaatgtggttgggtgtctcagaatcagagagacccatgcagtgtcccctaactctgatttccactggcaataggtgcacttctactctttccctatgacagcctgatggctcttgctgtcctcctcactgcttaagaagatattatgtccctgtccagaagtcgaccctctaaacatagacctggccatgctcattcattctttcaatagctattgatggctccaggatgcctaaccctaacctaaccctactgctaaccctaaccctacccctacccctaaccctagacagggccatgagtgagaacactgacgtttccattgagttcacattctagacaaagagtcagacacagtacaataaacactaacctcacataggaactgtttccaaaagtgaatcagggcaaagaggaaggagaaggtaattttggaaagggacaggtgaaaagctattctgaggaggtggtgttggaataaataattcagtttttggagaaagaagattccaagaagaggggccagcaggtgcaaaaggcctggggtgcatttgtcttgtgggaaatttgaacagcaggatgatgagtgtgtgagtctcctgtggttgctgttacatgggtctgtagggtgataaaatgagaacattttagtcaaatatttcagtgcccagtttgaggacagtaggttgataaaccagccaggaatattccaggctttctctcatccatttgcaagactgaaactggccttgtctgtaccatgtttcaataacaggctgccttattaacatgtactcctgtaggataggaaaaacgctgactcaataacactgcctgaaaaaaaatgcaacaaaatatgtttttcctctttctccctctcttcttattcctcctccctctcctctaattgtataaagtgatatcttattatcttcatttttatttctcattacattttgattttggcatctcctcgtactcattgaatgagttttctagggatgttgcaatgcattcccacaagttcagtggcttaaaacaacacacattgagtatcttccagttctgaaagtcagagtccaaaatgagtctccctgggataaaattgacatattggcaggaccccgttccttctggaggctctacacagggaggatctattttcttgccatttctagcttttaggagtgtcaactaaaaataaaatcctaacaccccctccccacccctgcacccctgctccctggttatctgaactgatccctcctctcagccaagggcactccaaagttaacctgaaaaactggttcaggccatgatgggaagtggaagctggacatgcctcatcatgccctcctcccttttggaatcactgatagaacagactctctaactctgataagaaacctttataatctattctctctggagcctgctacctggaggcttcatcttcatcataaaaccttggtctctacaaccccttatcataacccagacattcctttctactgataataactttttcaaccaattggaagcccctcttcctgccactttgagttgtcctgcttttctggaccaaacaaatatacatcctacatgtattgattgatgtgtcatgtctccctaaaatacataaaaccaagctgtactccagccagcttaggcagatgtcatcaggacctcctgaggctgtgtcaagggcacacccttaaccttggcaaaatagactttctaaactgattgaaatctgtctcagttacttttggtttaatgggagctaccaatgtttcttgactcatggcccctttctccatctgcaaagccagccatagccaccaggtctagtctttctcaagttgccacctctctagttctccctccccgcaacattttaaggaccttagtggtcacaagggaccacctgtgttactcaggatactccccttattttaagatcaactgatgagagaaaacttaattccatatacaacctgaatttcctactgccatggtgcataacacttgtataggctctgggaagtaggacatgacatctttgggatgggagagatcaccctgtctgctatatgcattcaaactattcgagtttcttcttgtaagaattatcattgctacccattttgcctttcctcgtgggttttattttcatcttaataggcatactggccaggagcagtgcctcatgcctgtaatcccagcactttgggaggctgaggtaggaggatcgcttgagcccaggagtttgagaccagcctggccaacatggcgaaaccccatctctgctaaaaatacaaaaaattagctgggcgtggtggtgcacgcctgtaatcccagctactcaggaggctgaggcacaagaatcgcttgaacccaggaggcggaggttgcagtgggccgagatagcaccactgaactccagcctaagtgacagagtgaggctctgtctcaaaaaaaaaaaaaagtagaaagattatttttaaaaaataataataataggcgtactttgtatagtttaggtattagcccctcatcagtttgacactgtgtgtgtgtatgtgcatgtgtgtatgcgcgtgtgtgtgcgtgtgtgtatgtgtgtgcacgtgtgtatgtgcatgtgtgtgtgcacgtgtgtgcatgtgtaagtgtgtgtgcgtatgtgcatgtgtgtatgtgtgtatgtgtgcgtgtgtgtgtatgtgcatgtgtgtgtatgtgcgtgtgtatgtgtgtactgtatgtgtgcatgtgtgcacgtgtctgcatgtgtgtgcatgcatgcgtgtgcacatgtgtgtatgtgcatgtatgtgcatgtgtgtatgtgcacgtgtgtatgtgcatgtgtgtgtttatgtgtgtgtatgtgtgcgtgtgtgtgttgcgtgtgtgtgtgtgtatgtgagtgtgtgtgagcacttttctgtgaggtatttctaaaatatttttctttcttctcacaattcaaatacttaaccagaatacctctagttgctatttttctttccataactttcatctgggactaattaagaaccagatagccagaaaggtcctatgaattattattttaagaataaagacaatgttattttgtagatgttacaaaaatacaatgaattgatttccaagaacaccgtgcactcttttttgtttgtttttagtgtctccaataatttatcttgtaggtaacctatcctcacagaagcactcagggcagaagaggagaccgaggtttctgtgcaattatttatttggaaatggagcccattcccttcctggagcaggagctcaggaagtggagggaaggacgtgaaacaggaaaagaggaaaagcccatttgaggatttatgactggatttgctgccaaagttgcaactacagttttttaggataactgtaaggctgcactggggagatgaaagaggaagctatttctccatctccttccgtcctctatgggtgaaggatggctccttctctcttctgatcctgagtgctggaaagctcaagaaattcttctgagaattgagtgagttcagccagcctggattccctggaattctggtgaagcctgactggggtaagaacaaagattgagaaggtttgacttggtagacaaccagtacctcatgaatagatatcctgtaacataaaatagtggtaatactaataataattatcattattattagcaataatgctgcaggtttgtcgttactgcctatgtatattttttccaggatgaaaaaacttcctccacattctaggagagaatttcgcttcacgagtaggtagtccacagaatcctaacctcacaggatggttcattcaaaacagattcaatgataaaacacactttagaaaggttaaatatatgttatccttggtagtgactcataaccctgttagttatggctgtgtaacaaattaaccccaacactgagccatttaaagccacacacaacacacatgtattgtcttggtttctgtgggcttgggatctgaggatgagccggcatggttagctgggtctcacagctgagggtctcttaggagtttgcagttgaggtggaggtgggggctacagcatctcagggcttgactgcagagggatttgcttccaagctcactcacattgctgttggtgggattcagttcctcactggctgttgtccagaaggttcctttcattctgagtcacgtggacttctccattgggaagcttacgacgcacaggctgacttccctcatagcaagcacccaatcaagccagtgagggggatgaggaatatggaagccacagcctttgtgtaacctaattttggtaattgcattccattgcagtcaacacattgtgttcattagaagcaagtcgtgcatcctgcctacactcagggaaaatgattatacaagggaatgaatgccaggagtggggggttcttgaagtttctcttagagtgagctttcctatgttggcaacatatgcagaatctctagtatatcaggttcaatcaggaagagataacctgcaaaatgggacaaaatatttgcaaactctgcatccaactaatattcagaatctacagggaactcaacaataacgaaaaaaatccgtataaccctattaaaatgtggttaaagaacatgaacacacagtcttcaaaagaagacatatcaatggccaaaaagcatatgaaaaattgctcaacatgaccaatcatcagagaaaagcaaattgaaaccataatgagatatattcttatttcaatcagactagctatttttttttgagacagagtcccactccgtcacccaggctgtagataatttgattattactgccatgccttggtatttgtgtttcaagagctgccagcaactgctattaaaggatgcatttataaacatccctgtgaaattgatcactgagtcagctcctgaaatatctggaaagactgtgtccactttatgtatctctcctctatatataggaagtcccaagaaaatgggagtccagtatcaaaaaaggatttgcttcttaaatagcaccacactttcttctatttaatattgaaaactgtcaaggactatgttctttctttatttagactgccagaaagtacagacacatcatcatctgtgttcatcctcgtggtttcattgtcagccctcactgtcatatcaccctggttttctatcactcatttataatctgtattctttatatcctatttttagttgcattttgtatatcttatattattctgtttcttctttcctgaagcgtcctccttcttttcaaaggacaaggcaaggccagacatgattgctcatgcctgtagttctagcattttgggaggctggggtggggggatcacttgagcccaggagttaaagattagtctgggcaacatggcaagaccttgtctataaaaaataaaaaaattagcccaacatggtggtgcacacctgtattcccagctacctgggagtgggaggtgggagaatcacttgatcccaggaggtcaaggcggtagtgagctatgattgcaccactgcactccagcctgggagacagagcaagaccctgtctccaaagaaagaaagaataaaggacaaggcatggcctgtaagttgacaaccaacaaaagaatcactacaattacaaactgccctccaatttggagcagttctggtggctcagaccatgtggttaaataccctggtttctaatgactttgagggtgtgaggtttcccatacacatacacagcacagcttctcagaggtctgaaaatggtttccttttctggtttgcactctccgctcgtaggttttacaacagacataaatgttcatgtcctatgtagcatgttcaacaattgtgcaatgtataatttcaccatttgcaaggatactaagtgagtggaaaactgaatttataacgttgatgtacattacacctgttgcctgatgtattagtcaggataaaagagaactaatagaatgtgtttgtgtgtgcatgtagttgacccttgaagaacacagctttcaacttatacgtgaattttcttctacctttgccatccctgagacagcaagaccaacccctccttttcctcctcctgctcctcaacgtgaagacagtgagaatggagacctttagg[223 bp omitted]tgaggcaggagagtggcgtgaacctaggaggcagagcttgcagcaagctgagatcatgccactgcactccagcctgggtgacagagtaagactccgtctcaaaaaaaaaaaaagaacatatttgctaacatcataaataaataaataaatagcaaatctattttttcttccttatgattttctttcatgacattttcttttctctagcttactgtattgtaagaatacagtattgaggccgggcgtgggagctcatgcctgtaatcccagcactttgggaggccaaggcaggtggatcacttgacgtcaggaattcgagagcagcctggccaacatggcgaaactccatctccactaaaaatacaaaattagctgggcatggtggcgtgtgcctttaatcccagctacttgggaggctaaggcagaagaatcacttgaacctgggaggtggaggttgcactgagccaaggtcatgccactccagcctaggtgacagggcaagactccatctcaaaaaaaaaaaaaaaaaaagaacacagtattgaatacatataatgcacaacatttgtgttaatcaactgtttatattaccagtaaagcatctggtgaacagtaggctgttagtagttaagttgtggagaagtcaaaagttataagtggattctttctttttttgagacaggttctcactgtgtgacccaggctggaatgcagtggcctgatctcagctcactgcagcctctgcctccccagctcaagcgattctcctgcctcagcctcccgagtagctggcatcacggatgtgcaccaccacatccggctaattttgtacttttagtaaagacaaagtttcaccaaagt[137 bp omitted]tgcctctaacctctgtgttgttcaaagatcaactgtatatatagttatatatacttttatataggtacacatatacatatgccaacatgtttatatttatatacatattttacatatgtatatgtttatatgtgttactatataaccagttacatatataaatatatatgtattgtgtatatatgtatataaataagtatatatgtctttgtgtatatgaataaatacacatgcatgtaaatataaatatatgtatatatacatatatttatttacatatacatacacttacatacatttatatatacatacacatatacactatatataatatataaatacatatactttatatacactcacacaaatgcacacatatatatattttttatacacacacacatatatatttctttacatacacacatacacagagttttgaagaaattggcttatgtgattgaagagacttggcaagcccgatatctccagggtagaccagaaggctggagacccagggaagagctgatgctgcagctcaagcccaaagtcctctgtgtggaggcagaatttcttcctcctccagggcccacagtcttttgttctcttacagtcttcagctgattggacaaggcccatgtacctcatggcgggcaatctgctttactcaaagtctatggatttcggcattaatctcatctagaaaatacctgcacgacaatgcctaggctagtgcttgaccaaatacttgggttccatgagctcaccaagctgtcacatcaatttgacccttgctctaaattttaaaatgttttgtattgcaaacttgcaatttctttgcttgtacacacccctctatgtaggacacttgtgctccacagtcaatcctgccaactgcacctcttactccagtcaatgccatcatggccagttgcctgcagcttttgccatgttccccaggtgtctcgtggctggcttgtctcaattgtgtggtggcaccttcccctcctgccaccttccttctctgcaaatagtttgacttttgcaaccaagcaagcaagacacaggagagaagagcctgagatggagcaaggactcccctctttggagcctgtgggattccccacacgtggaaataaaggaaaatcttgagttccttggagggaaattccaggcatctagctggctctaagaagtcaatgagcagcctgataagcaagaaggtaatcgtagcttaaaacaattgccaaggaagaagttagagtcacgagatgcttggctcccctacatgtgtttgcagaaactcagacctccacccaataaatctactaccctctcccctgaccacagataagggggactgggggttacactctgagcaccattccttgttctcaatttctttccaaggggcctggatgtcacggccctgggtcagaatgaaccttctttcctgctgatcccaaattttaagacaaagctttgcctgcttcgctgattacaaatcagagggactttgaatccacctagacccgtaggcctctgctttgggatttctcgctgttttaggtcaaaccaatgtataacctccatgcattgatttatgactttgcctgtaacctctgcctccatgaattaaagaattcataccaagaagccatcatgaaggccagggtttaaccatgagctgcccaattctccttgtttggttccctgcaaataaacaccttcctttctcccactgcaaacctcactgtagacatctggtcttactgcactgggtgagcagacctcagttcagctccaaaacaagatgatgcagcctctgcaccttgagaattgcaggctgctggacaaatgcctttgcttgcagcccttgggaggacagttctgagacacatttctcaagtccaggttagataagacccccgttgtctgtaacagggatgaagaccacaacccaatcttgtttgcctttctctctttccagtttcacacttgacccataaaccacttggcaaggaaacttcctgcacacagccctgcccaggcaatgatacccttgagtgagcatctgataagccaaaacaattaagaatgaaagaatgcaatgacttgcacagtgaagaatgcgagatccaaagtaaggtcttagctgtgagaccagccatgacatgagtgtgaaatattggagcctgtggcctgcactcaacagagggtgtttgcagcttatatggaaataaaattcataatactgtagggtcagaataggtagagggttttggatcgtggggtgtatgtgtgtgtatgtatgtgtattagtgtatatatgcacatacgtgtatatgtgtgtgtgtgtatatatatatatgtataaatatgaattagcatgtgtatctctaccttactccttgaggcaaaattcatcttctcatatactgggcagaaatattgttctcctcctacaaagtcatgttcaaatattgtgaccctaccttatccaattttattattcacataagttagttcacacacttctataaggcagttcaaatccttgatgaatatctacatctacatatagccatacatacacacacacatacatacatgcatctacatctagacaggcataaatgcatgcacatacatcacagatagatgatagataagtaataggtacatagataatagatagataaatgaataataggtgattgatagactgatgatataatagatacataatacctatatgaatgcatgatagataaacagatgatagctaggtagataggtagagaatagatagatgaatggatagataggtgatggataatatatagatagaaagatagataatagatgaatgggtggatggaagatagatgaatagatggaataaatatataacagatagcttgatagatggatgaggtagatagatacatagatagatgataagtggatagataatagataaagaaatacatgatagaagagatacacaatagctagatggatagatgatagatagtagatagataaatagatgattggtaaatagttatataataggcagataagaagagaatagataaatggatggatagatgaatagatgatacatagaaagatagcagatgaatggatggatgaaagacggataggtagatagaataaatatataatagcttgatagatgaatgataataggtagatagatgataggtagatagatagatgatagataaatggtagataatagatgaacgaatggatgatagaacagtaacataatagctagatggatggatgatagatagcagatacataaataaatgataagtaagcagatagatagacgataggcagttaggtagagaatagattaatggatagatagatgaatgaataatacctagaaagatagacagatagataatagatgaatggatgataaaaggtagatagataaataatagatgagacatagatagatagatgatagatagatatccattaaaataaaatgcaatgtcatgtgccaaatacttaatgcaaagcagtgaaggagacaaaagcatcttcttattggacttctgggctctgtgtatatcagagattctctaaattatgggaggaggtgactcaatttcatattaactcctcatacgctgatgcctccaactctccactcaaattcatctacctatctgcctatcacctaactacttatcatctatctatttatctatctactctctatcatccaccattcgtctagccattaggtttctattctgtctatctatcagccatttagatatgtgagacaagggaaaagggaagaagacagcaatggtaagcccaagaaaactcaatgagagcatgtttgcaacagtggatgccatttataagtaattttttactttattttactaaataagtgaatgcatgaagagcataggttgctgagggaaggcaggtgacagaaggaaacggtggcctgctcagaaagaaaaggtagacagaaaaaaaggggggctgcaggacacccagagataaactggtcaagatgtacttgtccttaggaaccaagaaacactcattaattcattccatggcgactgtttctccagcaagtggagagacagtaatctgatcccctgaacatggccccagtagcaaggtcagctctgggccaagttaccagttgggcaaaagttcccagaatgtctacctcgtcctttttggggacagctggttcctccacgccaaacctattcttgcagttctaagtctctaagtagccattcatctctcctcccaggcacgtgtcatgctatacacacctgctgtctttcttttttctttttgagacagagtctagctgtgtcatcaggctggagtgcagtggtacgatcttgactcactgtggcctctgccatccggattcaagcgattctcctgcctcagccccctgagtagctgggattacaggtgcgcgccaccacaccaggctaatttttgggggggagttttaatagagacagagtttcaccatgttggccaggctggtcttgaactcctgacctcgggtgatccacccatccaggcctcccaaagtactggaattacaggcatgagccaccacgtcggcccacacctgccttctgaggcattgaagatgcaccattccctgtatgtattagggttgcaggattaaatataagacttcgatttaacttgggtttgaagataaacaattattttaaaatatatattgtaagtatatcctacatatttaataagtcatactaaaaatgatccatcattaatctgaaactcacttttaattggacattttgtattttcatttgctagacctgacaatcctaatacagagcattttcattttgagaagtaaaagatacgtggattcctatgactccaaatgtctgcccctttagcatctatatgtgtgtgtgtatgtatgtgtgtatatatgtattgtgtatgtgtgtatatatatgtgtgtgtatgtatgtgtgtacatatgtgtgtgtatgtatgtgtgtatatatatgtgtgtgtgtatgtatgtgtgtatatatatgtgtgtatgtatatgtgtatatatgtgtgtgtatgtgtatatatgtgtgtgtatgtatgtgtgtatatatgtgtgtatatatgtgtgtgtatgtatgtttgtatatatgtgtgtgtatgtgtgtgtatatatatgtgtatgtatgtgtgtgtatgtgtgtatatatgtgtgtatgtatgtgtgtatatatatgtgtgtgtgtatgtatgtgtgtatatatatgtgtgtgtgtgtatgtgtgtatatatatgtgtgtgtgtgtatgtgtttatatatgtgtgtgtatgtatgtgtgtatatatgtgtgtgtgtatgtatgtgtgtatatatatatgtgtgtgtgtgtttctatacatctagctattgtgtatctattctatcatgtatttctttatctactatctacctatcatctatccattatctgtctacctatcatctatctatgtatctatctatcacatccatctatcaggctgttatatatttattccatctattcatctatcttccatccatccaattcatctgttatctatctttctatttatatatcatccatcatctatttatccattcatctatctattctctacctatctacctatcatctatttttctatcatgcattcatatagctattatgtatctgttatatcatctgtgtatctatctgtcatctattatgcgtttatttatctattatctatatacctattacttatctatcatctatcttttatgtatgtgcatgcattcatgcctgtctagatatagatgcatgtatgtatgtgtgtgtgtatgtagatgtagatattcattaaggatttgaactgctttataaaagtttgtgaaccaacttatgtgaataacaaaattggataaggtagggtcacaatatttgaacagtatatattactgggacgattttcctgttttcttcaaatcccaccttgttaacaagttaataataagattgataaggtcaagtcaggttcctgagctttagccatgagctgcatcttccttcttccctgggtcagaagactcacagatgatcccttatgcccacaggcaacagaagcttttatttgaaagtagcaatgcagacagaatgtatttttagaaattcattaacatatgggatgctaaagtattaatcttatcctcctttgatcactttcagcctcatgctttctgggtgtttttataatacgtttcttcacatttgcaaactattacatgactcacatttgggaaataaaagtgacattagttcaaaagattcaaacttcttcattttgactctaaaatcagaagtaacctttgatgatctataaacgctttggatctttaatccaactatacagcaaaggggaaaaaattggcatttttaaagatgtttttattggaactcttcttacagaagaaaaatcagcagttattttactataacagaatataccatcagtgcaaagcataaagcattttaactgagtatgcaaatgctacatggttattccaaagggaagagaggtgaatggaaaagaagataagcatgatttatagtatgtcagtgcctaagactgttaccttcttaaagtaaccaataaagaagagcaactgtatctacttacataattttagcaaagaccttgaaaactgcaacaatttagagcaaatgcatatttgagctgtcattaagcaggtagattaaaagaggaaaatagtggtagttaaacacaaatattatgatcagaagcgtttaaaactgaatgaagcacatggcaagcagccatcattctgctgctccacatctaggaagaaaaatgccaaaataaggaaggcaatttccaaaataaaaaaataaagccttcgctggaagaacgtctccatttttctttattctttgtgggttatgcctactcttccagttactggtcatctgggaatctgtggttgcaaattgttaacatataatttctttctaagataccacatggtgcccctggaattagagtagatgttctttgggggcttagctttggtttagaattaacaaaatgatgagcaggcggaggatttactttaaaggaggtttaagattccttcttggctccaaatttatccagcattaaattaaaggcctatgagagcaagtagccactaaataaatcttttttcaaacattaagtgtgtatatcatatttaggcacacgaagggtttctgaggtgaatgtgtttcatggatggattgcctgggaagggagtcctaatataaaatgggtactttctaatttgggtatgtatggctttattcataaagaaaaagcaaactagaaagatatgagacatcacccacaaccaatgcttcagaaacttcaatgtacatatggatcctgttaaaatgaagattctggtgtggcaggctggggctgggacccaaaattctgcatttccaacagctcccaggtgatgctgatgctatgagcctatggaccacactgaagggctgtgccccagcccaccacatgtaagtcacaatctccaggagcagaacctggcactggattcttttttaaactcccaggggatgctaccatgcaatcagaattcaaaaacatgaatgtacactcatagatgggttttccagaagagaataaaacctaaaatcccttagagttgtccaagttcatgttacaagacagcagcatcgtgaagactacaggctacttccctgacctctaggtcttggtagctgacactttattactctaatgcgggggaccccaaacccccaggccatggaacagtagtggtctctccatcatagttcctccttttactaacatcatggctgcaggatgccctcttacgatttaaaaagtgacatcaaaccaaaggaggtggccgggcacggtggctcatgcctgtaatcccagcactttgagtggccgagtggaccagtcctggtccatggcctgttaggaactgggctgcacagcaggaagtgagcagcaggtgagcgaactttcgtctgtatttacagccatttcccattgctccttactgcctgagctccacctcctgtcagataagcggcggcatttgattctcatagctgtgtgaacccgatagcgaactgtgcatgcgagggatcaaggctgcgtgctccttatgagaatctaatgcctgatgatctgtcactgtgtcccatcacctccaggtacaaccatctagttgcaggaaaacaagctccgggctcccactgatcctacgtgatggtgagttgtagaattatttcattatatgttacaatgtagttattataaaactaaagtgcacaataaatgtaatgcatttgaatcatcccaaaaccacccctccccagtgtcagtggaaaagttttcctccatgaaatcagtccctggtgccaaaaagattggggaccactgctctagtatatatggtatgaagaactttaattgattaaaagcaattaagtgctaacagtgaagaggtatgaatacaagagtaaagggaaactgaattacaaaaaatatttttccattcctcctttggttttggggattttgggttttgttttgttttttgagacaagatgttgctccactgcccaggctggagtgcagtggtgcgatctcggctcactgcaacctctgcctcctgggctgaagcaattctcctgcctcagcctccagagtagctgggactataggcatgcgccaccacacccagctaatttttgtattttttgtagggtttcagcatgttacccaaactggtctggaactcctgaggtcaagcaatctgcccaccttggcctctcgaagtgctgggattataggcatgagccaccacggccggctccctcctttggtttgatgtcactttttaaatggcaagagggtatattgcagctgtgatgttagcaaaatgaggaactatgatggagaggcagaaagtgacagggaaagtggatgaggagagaagagagacagatcagatggggaagatttggtcaggaattccttgggcttgagtttgtaaaacagactcctttggcaaagccagattgccatggtgtcgatatctcacattctttctcc[141 bp omitted]agaaaccccgtctctactaaaaatgcaaaattagctggatatggtggcacatgcctgtaatcccagctattcaggagtctgaggcaggagaatcacttgaaacagggaggtggaggttgcggtgagctgagatcgcaccattgcactccagcctgggtaacaagagcagaactccgtctcaaaaaaaaaaaaaaaaaaaaaaaaaaaaaggccctatcggtgttaaatgttgcccacaccacaaaagcactttcttaaagagccattgacacgttgcctgaagtcctattgacagaaagcagacaatacagtcagcctgaacaattattccttttgaaggcagctccaaaagacaggctcttctctctgctcagagctttggaaagaaaaaatcccagcccgggctaaagagaaaaatgcttgcaagatcaacctgcattgtcctgtcacaaataagcacagcggggaatatacaggaatgtccaaattgctgcctttctgagatttttatttcttcaaaatgacaaggcattcagcaaaacatgagaaacaggtttgcacagattgtcttgtggggaaatcttacattgaggcatatccttttggcaactttgtggaaaccatcaatgaaacatgtctggagggaagtcatcgattctacattgagaaggtgctgtgcagtggaacctcctacaaccccacttctggtttcagttggcataaaatagcaagcattgttcatatatttctcaccctaatatgctttagagtatttcttatttgaagggatcatcattttattttagttatatttttctgatagaagaaagattaaatagaacaaatgttaaattcacaagagcaaagacatggaatcggcctaggtgcccatccacaatagactggctaaagaaaatgcacatatacaccatggtgcatatataccatgtaatactatgcagccataaaaaagaagaaaatcgtgtcctttgcagcaacacggatgcagccattttcctaagtaaattaacgcagaaacagaaaatgaaatactgcatgttctcatttataagtagaagctaaacattgggtactcatggatataaagatgagaacaacagatactggggactactagaacagggagggaggtggagggaaagggttgaaaaactacctattgggtgctatgctcactacctcagtgaggtgatcaatcataccccaaacctcagcattgcacaatacacccatgcaaaaaacctgcacgtgtaccccctgaatctcaaataaaagttgaaattagtacaaaaataaaaattttaaaaaggaaacactaaaaaagaaaaaaactgtagcaaaaatgtttctattttacagaaaaaaaaaaaaacatttatttatgttttgaaaggactccaagatcctgaatgaagaaggaaaaaagaaaaaaaccacccacatataatgatcatactgtgtcctgaaatatgctgttgggtagagtagtagttaagaactcacactcatagccagatccctgcatctagagtccagctcccacttggataattatatgagctctgactcactggtttaagaaagataatgtctgcaaatcaattagcaatcagcccagcacacagaaagcattcagtaaatactatcatgatgattatatatactttttatttctttacaacagagaagttcgttcactgctgtgtttctcattactttacacatgttagctgttggttttactttgctctattccagacataccatccactgacaaggtgccaaagccacaagataatttaagactcatatgaggaggaaggtagggggcatccagaggtgaaaatacccccagggcattgtaagataacacgtgcaaataataatagttgttgttattacagcaatgtgaagactaggaaataatgatttatgattatccattggtcctgccaagaatgatctcagcaagcagtattttaggtaaataatgtgtgggaggttcttaggttaatatagccattgaaatttgaaaaacccaattcatgaggcaggagttcatttcccttgttatacaacagagctgtgcgttggctttgtggtcaaagactttcagtaagctacgccagcctgtgctatctgcatgaacgcggcgaattccctgccagtcttaactccccgtctagacatggagatagtctcctgattagatatccagtagggaagctttgtaagaatgccagcagcagacctagggcaccagaggatgcctgccatatcttgcctccaataaacattgtagactaactctgaagcagaaagcatcattacattacggagacatttcatttggcatctaaaatgtcacacctccttgaaacattgaggtgtgtgtgtgtctgtgtgtgtgtttgtgtgtgtgttgtcccattagcgtgttctgttggtctggccttaataatcacttcactatatattgatcattgagcatatttttacaaaatgtaaccatatgtagggattgaacctgattgattgagtttgcttttttttcagatgctctaaaaacactgtcctttttgtattccatttcccttgtgttttaaaagggctcctgacttaggagtttctgtaaacataaccatggattctcccttccctttccaccagcctttgattgctatggctggagtatttgtcctctccaaaactcaagtggagatgggcacagtggcttatgcctggaatcccggcaatttgggaggctgaggtgggaggattgcttgagaccaggagtttgagaccagcctggccaacatagcgagccctcatctctacaaaaactaaaataaaaaattaatgaagtgtggtggtgtgcacctatagtcccagctagtaagtaggctgagatgagaggatggcttgaacccaggagttcaaggctgcagtgagctgtgattcaccactgcactccagcctgggtaatggagcaagaccttgtctctattaagaaacaaaacaccaaaacaaacaaacaaacaaaaaaacgcatgttgaaacttaatcgccaatgtggcagtattgagaggtggaatctttaacaggtaattgagtcatgaggactttgccctcctaaatagattaaaccatccatgtattaatgggttaatagattaacgggttttcccaggggtgggactggtggctttttaagaaaaggaagagagacctgaactagcaccctcagtcctctcaccatattatgccctgtgctgccccagggactctgtggagagtccccaccagcaagaaggccctcaacagatgcccctcctcaaccttggacttcacagccccataactttaagatgtaaattcctttttcttataaattacacagtttcaggtattctgttataagtaacagaaaatggactaagacaccaatagaaatcaaatttttcataatttttatatttatttctttttaacacagttgttatcatgtgaatccatctgtgtcaccctgagccaacattctctgcaatgttattgtccacactcttattggaccttttttttcttaacagagatgggaatctcagtctgttgcccaggctggagtgcagtggcacaaacatagctcactgcaacctcaaactactgcactcaaacgatcctcccgcatcagcctcctgaggctctaggactacaggcacatgccaacacacctggctaagtttttaacattctttttattttttgtgcagacaaagtctttctgtgttgcccaagctggtcttaaactactggcatcaagcaatccttccacctcagcctcccaaagtactgggattacaggcatgagccactgtccaaacctattgcatctttctggatgtactcttgaattctttaagtgactagatattatttctaagaattggctcaatacatattttgtatgaattaccagttttctcttccatacagactgcatctcacccaggaggaaaagtttatatcttctttgtaaattctgagcatggtaatgatccgaattgcattggtatgttttgtatcttacagtagtgactcatttgaactgagacagaagagtcttattcttacatcaggtcttaatacattttagagttgcaaagatgaacttgcatttatggcagagcctttaacacaacttttaggagctcttcccgcttccatttataatgaaaatcacacttcttgccagtgttaacctaagcaacatgcaacaacacccaatgatgttattatcttctcatgaaaggacagagacattaattggtccttgagttttctaatggaaagaccttagaatagactcaagttctgctaggcagtgtaagaactacactgtattagtctgttcttacactgccataaagaactacctgagactgggtaatttataaagaaaggaggtttaattggctcatgggtctgcaggctgtacaggaagcatgttggcttctacttccaaggaggcctcaggaaacttacaatcatggtggaaggtgaaggggaagcaggcaagttctacatggctggagcaggagggcgagagagagaaagagatggggagatgctacataattttaaaaaaccagatcttgtgagaaccatatcagcactagagggatggtgataaaccattagaaaccatcctcatgatccaattgcctcccaccaggccccacctccaacactagggattacaattcaacaagagatttgaatggggacatagatccaaaccatatcatacaccaaaactcttctccagatagatagctacaaggaaaatgccaacgagaaagcttctttcaccaagtagaagcttctttcaccaggcagaagctgacttgcttgcatttggaagaatttttttttttctctgtgtaagtttttgtaatacagtgatattttaggaaaaagcatctaactatctttacaaaaagaaaccaactaaaatacaatattgttggtttattttgcctttgtaattttttaaattcaggtggtgcatgttcaggtttgttttatggatatattatgtaatggtgagcttgggtttctagtgaactcatcacacaaatagcaaacattgtacacaacaggtagtttttcaaccctcacttgcttcccaccttcccaccttttggagtccccagtatctattatctattattttcatcttcatgtccatgtgtatacattgtttagctcccacttattagagagatcgtgcagtatttgactttctgtttctgagttatttcacttacagatagtggcctccaattccatctgtgttgctgcaaaagacatgatttcattcttttttgtggctgaatagtattccacaatatatgtgtaccacattttctttattcagtcctacaatgatggacacttaggttgattccatgactttgctcttgtcaatagtgctgtgataaacatatgagtgcaggtatctttttgatataatgatctattttcctttgggtagatacccagtagaaagattgctggatggaatggtagttctatttttacttctctgagaaatctccatatcgttttccacagagattgtattaatttacattcccaccaagagtatataagtgtttggaagaaattgattagtgatgtagtaaaagctaacatatattgaacatttgttaatatccaggaattttccaaacagttctatggagttaaattgattgccatgagtaacctcattttacaagtaaggaaaaaggggctttgagaatgtacacaatgaactagggctgcagagctttggaggtactgagctggcattagtccactgctatgggctgaattgagtccctccaaaatttatatgttgaagtcctaacccctagttgctcaaaatgtgactatatcagaaaatggggtttccaaagaggtaattaaggtaaaatgaggttattagggtgggccctaattcaatatgactggggtccttataagaagaggagataaggacacagacacacacagaaggacaccccttggaggacacagggagaagatggtgtctccaagcccaggagagaggcctcaggagtaaccagccctgcccacaccttgatctgggacttccagcctccaggactatgggagaatcaatgtctgttgtttacaagccacctagtctatggtattctgttatagcagcctgaaatggactaagacatctcataagaggaggagatgaggacacagacacacacagaagaatgactctgtgaggacacagggagaagatgatgtctacaagccaaggagagaggcctcaggaggaaccagccctgtccacaccttcgtctgggacttccaggctctaagaccctgacaaaataaattccttttgtttaagccacccattctgtgggacttcattatggcagccccagaagactaacacatacatgaacattggagttcagagccatgtcttaaagcaataaggtctgttgtgttagattaaaggttcatagaattgaagccctcaaagctatgactcagacttgaaatgcattcatcctctcatcctcctcacctctgaccgacctgaagaagtgctgatattcatctcgatgtaaaaatctgttcaacattactcagggtctcacagagccagccccaggtctcagggcaattcgggggccacttgttctggcccctttaagctgcccagaaacatttcctaagtccacacaacctctctcctcagctgtgaaatcttgacacttcactaagtatgactctgtcagagacgtgtgaagcagagcaactccatcttgaataggagctaggtaaaatgaggctgaaacctactgggctgcattcccagacttagaagtcacaggatgagacaggaggtcagtataagatacaggtcacaaagaccttgctgataaaacaggttgctgtaaagaagccagccaaatcccaccaaacccaagatggccacgagagtgacctctagttgtcctcactgctacactcccaccagcaccgtgacagtttacaaacgccacggcaacctcaggaagaccctacatggtctaaaaaggggaggcatgaataatccacccctcgtttagcatatccattaccaagtagccattcttctattcctttactttgctaataaacttggtttcactgtactctatgaacttgtcccgaattctttcttgcatgagatccaagaaccctctcttggggtctggatgaggacccttttcctgcaacaaatcttccaaggtttaacagtcctgtatttaaagaaaatatcctcccagaaaggacacagggataaagcagaatgagtgatccactgaacgcaatgtgtttctctgagaaagcaaggcaaggacgatggatagattgttgagcaagcgatgtgggagaagagggcatgggagggaaggatgggaaatgacaaggcagagaggctttggggccaaggaggtgatagaacaagagtaggaagagagagaagatcggggagaaaccaactgcaattctgactgcagatttcctgccctgctgttagagttcttcctcctcagccagcccctggggcttctgatacacttccttccatcctttatcccccacgtgggagggcaatttcctctccagaaacttgctccctccagcagcagccaaattctcacctgcaacatttccggtggcctccgagaaaccaaccgaccactaggtaaaaatctcagcctagctgtgttccttcaggaaagaagagcctgtcaccaccttctgtgggactcctccctgctctcacctggctagttcacactgtctgtctcctttccctcgcccaggaagattgactattgaccacacactgaacacccaggacggtggccggagtatctggaggagatgtccttcaacgtggtctggccctttcatccagctgagggcggaaatggcttttgcagctaggcctatgtgcagagaaatgctgacatccagagaaacaaaactgcttcccacatgcaagctgggcagctgaacaggcttgtttgggtggcaggggattctcctgacttcttctggaatctattataattctttttccaacattttgaatatgtattttcaggaatggttctgcttttcataggcttggtgacttttggaaattcttagaaaatggacgttatctatctttgcgtattaattatctctcttccaggctttcaaggacaacaacaacaaaaaactcttttggggggagataagagatatctagattgtacttcagtcggtgaaatgtaatgcacaatttcttactgaattgaaaccttattgaagacaaaactctgaccttttttcttctcttgccaaaattcctatctaaggggtctcgggagtcatgccctacaaatcataaagtctcctgagaggggttttatttaacgctgtataacgtggcttactttccaacctgactctggcataatatcatatgacagttaagaaaggaaatcaaaatattttaaccccaaatatgtttctttgccatatcttgaaatagccctgcaaagctgtctcttgtgagggaaaatctacattctgtagagaatctctttcccttttccaggactccttatcttaacccagacatttcctttctattgattccaggtctttagatgaactctttcaaccaattgccaatcagaaaacctttgaatcttcctgctataacctcgaagccaccacttccagttgtcccacctttccaaacaaaatcaatgtacatcttacatgtattgattgatgtctcatatctccctaaaatgtataaaaccaagctgtagcctgaccaccttgggcaatgttctcaggatctcctggggctgtgtcactggccattggccactcatatttggctcagaataaatctcttcaaatattttacagagtttgactcttttcatcaataatatatatacaggtaagaaaaataataagaagcaagcagtttctttctgatgatataagatatgagataccaaatgtaaatgacataagatgatggggaaacagaagaaatgaacattagcaatattctttgagttgtggatacttgaagtctccattccctttatttctggctcactctaatcttgtaacttcccaatgggttcaccttgcccgctgcctagacagagacgatttattaagacaggggaattgaaatggagaaagagtaattcatgcagagccggccatgtgggagaccagagttttattattactcaaatcagtttccctgagcatttggggatcagagttgtttatttaaaaaaaaaatttattgaggtataatggacatacacgaaactgcatatatttaaaatgtacaattagataatttttgcacccattaaatcatcaccacaatcaaggtcatgaacatatccgtatcccaaaatgcttcctttatccctttttttttttttcttgagagagagtctcactctgttgcctagactgaagtgcagtggcgcaatctcagctcactgcaacctcggggatcagagtttttaaagataatttggtcagctgggccttgggaagtggagagtgcttattggtcaggagatggaattgtagtgggtcaaagtgaggttttcttgctgttttctgttcctgggtgggatggcagaactggttgagccagattactagtctgggtggtgtcagccgatgcatcaagtgtaggggctgcaaaatatctcaagcactgatctcaggtttgacaatagtgatgttacccccagaggcaatgtggggaggttcagactcttggagccagaagctgcatgacccctaaactgtaatttctaatcttgtagctaatttgttagtcctgcaaaggcagactggtccccaatcaagaagggggtctttttggggaaaaggctattttcaattttatttcagattcaaaccatgaactgaattccttcccaaagttagttcagtctatgcccagaaatgaacgaggacaatttaaaggttagaagcaagatggagtcatttaggtctgatctctttcattgtcataatttccctcagttataatgttgcgaaggcaatttcagtctgaaatctatcctatgacttaatcgcagctctctgcaagctcaccataattcaattaaatcactcaatccactggatgcaattgaccttcacaattcaacagacaattgaatgttggagcacctcaaaaccttctcctggactatttcctcttattttattcaccttttgtaagtttttccatctctgcccctgacttctatcaacgtgtgtagatcagtcactccaaatgtatgtttccagttcagatcttgtctacatactccagacccatatatccaagtcctttcaacatttcctctcagatatctcaaaggtcattgcacttatcaatgcctaatactctttgggtatttttcccttccaaatctcatgttgaaatttcatctccaatgttggaggtggggctgagtgagaggtatttgggtcacaggggtggattcctcataaatgccttggtgccattccctggtaatgagtgagttttggctctgttggttcatgtgagagctggttgtttaagggagcctggtatctgtatctggcttcttgtcttgccatgtgttctatacacacaccagctccccttgccttctgtcatgacgggaagatgcctgaagtcctcaccagaagtagatgtcagtgccaagcttcttgtagtctgcagaactgtgagccaaataaacctcttttctttaaaccacccagcctcaggtattcctccacagtaatgcaaaacagactaacacaagaacaaagaacaaacttgtgtcccagcctttcacgtccagttccacaagtcaagaatctagaggtcttcattttctccttgcaatcaatctatctccaatcctcatagatgtttctcatttgtctgcatttctccttttctatcaccaaccatctggtggaaactaccttggcctctgacctggacgcttcatctgcttcctaaatggccacctgtagacctggtattcctccttccttcatccatttatttatttatttatttatttatttatctattttacatctcgaagagtttgcactcttgttgcccaggctggagtgcagtggcacgatctctgctcactgcaacctccgcctcccaggttcaagtgattctcctgtctcagcctcccaagtggctgggattacaggcacatgccaccacgcccagctaattttttttgtatttttagtagagacgggctttcaccatgttggccaggctggtctcgaactcctgaccttaggtgatccacctgcctcggcctctcaaagtgctaggattacaggtgtgccttcatccttttaactgcttgccattgctcttacaatggatgtcattcttgatggccctcaagatgctctgctttgcctggttttggctctcacttctctctacttttcaccttccctgaaaacctagattttctctagccctacctacccctgctgcagaccctttgccatgctgtgtcttctacttggagcatgcagaatttatctgtgacctcctgaactagttcattccctttgttacaatttctcctggcatcatatttatttccctcatagtacctaccacagtctataatgatacagctatttgtctgatttttttaattactgtctgcctccactaaaccatgcattccaggagcatgctttgttcattttgttcactcccttattgccttcattgagtattctgcctggaagagcatcggcacatcacccatacccatgaacaaatggatatgagcaccacaactgctgagctatctacagacttagcagctaggaagcttgtcttggatgagaatgttaaataggaaactctatccctcaggagtttccattctggcttctcctactgattctgaaaagcaaagcatgtgcttgagtgactcacacagcacagtgcatgaatatgtctgaagaggttccttatgtagctcatgggaccatgtttaattgaataatgttctactactcaggtttttatcacttctgtacactgaaagtctgagagtaaatgattcttctcaatgcatttcttacctccaattacattcaccctaataattgtgttattcattgtatgacctcagcctgtgaagcaagctgtcatgtttttcctcaagccaccaagacttggggtcaagatgcttggcagggaatggggcagttggaaaacactaaggagcatttcttctctgctcaagggcaatgattaatttggaaatgggagatactttgatcaaccgatgctactgttgaactccttaaattatgtgtattaattattctattttcccaattgcagcaatgacaaagtcacagagagattcctgtaagacagagtacctaaaaaggagagtggtgtatgtgtgtgtgtgtgcgtgcatgcgcacacttgtatgtagaattccaccaacactaggataaatgtttgtctctgtatttagcttggctataactccataacatgaaagtagactcatttaagtcatcagtgaacaccatgttaaaccctaagacagatggatataaggataatatgtatgcatacatgggccaaggttgcagcatacagcatattaatgaatcctgtcccaaacccagcaagttccttagatgtttaaaaaaaattattcaaattgaagtcaatatccaactacaggtagcttaaactttgcaaaagaaatgtcttattagatgctagagtgacttagaaacattgaattccatgtctgaagcttttttcttaactctaaagccttttaatgttatgagttgactccagggtaaaatttagaatatgtatatagagagactgagtatccctcatacaacccttcattactaatgtagtttaccttagagtctaaagaagattgaagagtagaaatttcaaagttagcatcttcagcaagaacctagtccagatattgacgacaactaagacagcaaaagttagcattgtgtcttctcatgaaaatggaattctctagcaaaatgttgcatctaatggataccaccacgcaatcttgcaagaaaagggactggggatacctctggtggggaaaaaatttccccagagaataattcagcattggtttcagtgaacatatggttgttgaagacttactaacaggaacattgacaaataatgatgtttctggattaatttatttactcatttacattttaaaaatcatttattaactcacttattggtaccatgtgccaatcttccactttgcccaaaggggatgccaaattcatttaccacatcagttaacaatgaaaacaaacaaaaacttgtttttcattaaaagcaaattcagtgttccaaaatggttgatttgaatgatctaatgtctctgtaaagaaaatctctttttgacaaaagagaaaactacttggccccttcccatcccacccacaaggactgaaagagatattctgcagttttccctaaaataggcctgtggctttaatgttaactgttggtacaacttttgttgttgtactgtgctgggaaaaagcgggtagaataataaatctaccttttattggtcttacaaaggaaaaatgcacgtaaaaggatttcgatagaacttttcaataaaagagaaaaatgaactttctgtcttccaagaataccaaaaatagagtctgcaggaatatcaggcaggagctattaaatgccctatagatcgcatgaacaaataataagttcctgggatcctttatggtcatttataatatcgttgaactgaaaaagcaaccaataaacagataaacagatagcttactttccttgctctcaaggaaagagtcaaagaaatggagattttagagataatccattggtataccagcaagaccaagtatctctgggctcagtaggggtgtatgcagagccacatggatagaaaaatctgtgccataaatatgtgttttcccacaagcccgcccacatcacatagaggtcacctttggggaagattttgttattttaactaaaattgatctgtttcttttaattttaaaatatttaatttatactaaacaatgtagaagaatgttctttaaatttgattcaatataatttttatgtataaaaattgggcaatattttggaatataccctttatgttatatatatgcacacacacatagcacatacacatatacataacatttatttcatatgtctataagatgtgaatacacatatatacatataaacatatatatttgtttatgtgggtacatgctatggactgaatgtatctccccaaaattcatgtgttgaaccctcatctccaaggtgatggtgttgggaggcggggcctttggaaggtgatgaggtcgtgagggtggggcttcatgaatgggataagtgccctcataaaagggatcccagatagctccctcgccccttccaccatgtgagaacacagcaagaaggctccatctaggaaccaggaaaccctcactagacactgaatctaccacaccttgatctgggacttccagcctccaaaaatgtaagcaataagtgtcttttgtttataagcctctcagtctgtggtattttgttatagtagctcagacaacatacgacagtatatattagtatttgtataattccatttcctgagcagttttgagtaaagtaaatcatgaatctttgaatttatgccttttcttatctgctttatctttaatccttatttttcttcttatagaatattgagacataaatatttaagtgtaaaattttcatcataaaaaaggcagaagtttgaaaatatgttgcaaattgaaattagactttaacaaagtgtattgttaaggataacaataaaaaatattttactccgcacgctagtaatatctggaagctcaaacatcaaacagtatttatagtattcatcctgatcccttcgttaatggcaagtgagactgagcatagcaactgttggcctaagaccatacattttcatttttcagtaaatattaacttcataaatgaaattattggctccccacgtttcccatgtaaagtatcatatggcatgtacgtttgaatatccagcttcaaaagttactaatcaataaaattgaaagtagcaatgttgcaatagaagcatcaattcagtgagttttcaaagaagctcacagatttactgtttgtgaaactcacattttccatctgttttctaggaaaaagttatcccagacagacaaattagatcctggtagctgaaatgatcttaaagctgtcaactactataagcagtaagtcccaaatggtgggtgaagggtggtacagtatcctggtatctatcaaagctatctctaatttatttttttatgggcaatgaggaatgccacttaatcttggaacgcttttttcttgtttttctccattacatataaataacattgcatttggaaaatagctcaattatccagttgtaagaatacaattgaactatagattctctctccttacatctcttcttctgccagcttttgcttttttctcaattattcctgcttccctccttttcctcccattcatcctctttatccctctttggaaactgtgcctcctataaaagatggggccaaaatgctaaagaaaacacgctttgtctaaatctgcatgccactaatatccggaagctgaaacatcaaacaatatttatcgtattcatcctcctgatcccttcattaatagcaagatcattgccatcagtattttgtgtcacaaaaaccatctgctttgtattactttgctcaggcttacataacaaagaaccataaactgggaagcttaaaaaacagacatttatttctcacagtcctggagtctggaagtcccagaggaaggtgtgggtggggctggctcctcctgaggcctctctcctggacttgcctacaccgtcttctccctgtgtcctcacagggtcaaccttctgtgtgtgtctgtgtcctcatctcctcctcttatgagatgtcttagtccatttcaggctgctatcacagaataccatagaccgggtggattataaacaacagacatttattctctcacagttctggaggctggaagtctgagataaaagtgtgagcaagactggctcctcctgaggcctttgtcctgagcttgtagactccatcttctccctgtgtcctcaccaggtcgtctctctgtgtgtgtctgtgtcctcatcttctcttctcataaagtgtattagtccatttcaggctcctacaacagaacactgtagactgggaggcttataaacaacagacatttattgcttgccattcttgaggcttgaaatccaagttaaaagcatggcggattcagcgtctggtgaggccccacttcctggttcatagacggcaccttctcatgggtcctcacatggtggaaggggcgagggagctctccgaggtcccttttgtaagggtactcattccattcatgaggctcttcttgagccctgggagtaagaattccaacgttgaatcttagggggacacaaacatttagacgataccataaggccaagagtcgtattgaattagggtccagcctaatgacctcatgtaacttaattacctcgtgaaagacccaatccccaaatacaaccatcttccatggcactaggaattaggacttcagcatatgaatttctagggacagaattcagcccataataagttccttcaccaaccatgttatcatccttgctccctagaactcagacatacatctacccacccacacccatacacacacacacacacacacacacacacacacacacacacacacacagatccaaatgtccattgggatacataggacctctcaagttagtgatattcttttttaggtttggagattctagctgcattcacaattgaagctcactccatcctctgggatatcttgatttaagatggtcaccaaaccagtaacactacagagactgttgtgacatttgcaaatgcttgtagacacctaacggccagttcctctttttattttatttttctaagtagtttattatttctaagtattatatggtatatacatttgaatatcaagcttcaaaagtaactaatcggctaggcacagtggttcatgcctgtaatcctagcactttgggaggacgaggtgggcagatcacttgaggtcaggagtttgagagcagcctggccaacatggcgaaatcccgtctgtactaaaaatacaaaaattatccaggcgtggtggcgtgcgcctgtaatcacagctacacaggaggctgaggcaggagaatcacttgaacctgagaagcagaggttgcagtgagccaagatcatgccaatgcactccagcctgggcaacagagaaagactctgtctcaaaaaaaaaaaaaagtaactaatcgataaaattaaaggtggcaatgttgcaacagatgcagccattcagttatttctcaaaatagcctcacagaattctttgtctgttcaactcacattttccacctttgtttctagggaaaggttatccacatgaaaaccaaataccaaatgttctcatttaaaattctttaaataaatttgattgtgtatatgtgaggtttacaacatgctgttatgggatacatatagatattattaaaatacaaatgtaatatatccatcctctcacatggttttttccatgtgacgagactgcattagggatgtctgtgccttatggtttatgatggtgaagttaaagccacgtgggctctccatgaattccaggtggagacagggcagccatgaagaagtcacagtcgatgaaaaactaccctgctagaggcgcctgttttccagaagtcagtcattctgctgcctccactcttgggcaatacttttcaaaaggataacattccataagaatgaaaatacatgtgggctttctgtatttttagagtcctattgaaaaatttaggaagtctggaaagctaattctctgtctgatcagctaatgattgtgtaggatgtgagcatggacacaactacgcatttgtaactctcatccctcccacattccagaaggcaatccacattttggacagaaatttaagcaaaatatttgccactaattgaagggcactctaagtatgtcttgagtgcataccattgataattaattccattttcagttttataataacgattctgcatctaggtggcttgccagttttaaagtctctcaggacccagccaagactttgggatcaattactctaccagggcaccctccccaagattattctgatgccccctggaattcccagatggccagagctagaaacgttagccaaaagtggctcatgtgtcagagactttctatttcccatttatgctgagtcctgtcaattacccagtaagagaccatttgcaaacagtttgcactgaggtttcagtaaagtcacctctgtgattttttgtttcccaaaacaaagacagtggcaagtaacctaagtaaagcagtgaatgagttcaggactggctatgcagtctgtaaacagttctctctctgtaaagataccacagaccctagctgtcctgagtacagggccacacaagaccattgtatgagtcagctgaggccattgtaacaaaggtccacagaccagggggcttaagaaacagacatttattctcccacagtcctggaggctggaggtgtgagatcaaggtgtgggcagggctggttcctcctgagacttctttccttggttcgtagacaccgtcttctctctgggccctcacagggtcatctctccgtgtgtgtctgtgtcctcattgcctcttctaatgagatgtcttagtccatttcaggctgctatcacagaatagcatagactgggtggcttaaacaacagacatttattctcgcacagccctggaggctggaagttggagatcaaggtttgggcagggctggttcctcctgaggcctctctcctgggcttgtagatgccatcttctccctgtgtcctcacgtggtcgtccatctgtgtgtgtctgtgtcctcatctcctcctcttatgaggacaccagtcacattggatcagggttcaccctaatgacttcgttttaccttaatcacctctttaaagaccctgtctccaaatacagccacattttgatgtcctggagttgaggacttcaatatatgaattttagggggatacaattaagcccatcacattttttttcctttctgactcaatcctagtggacagaacaaggacaggctttcaataacttgccctgaacttttttcagaatggctgagatttacctgatgaaacaaaccaatctaagaatatttcctcggggctcattatgtataaaaaaagtggtgcaaccaaaagctcagactcaaaacaccgggtttgagtctgaccctgatcactcactagatcatgagtcctaaacggtacacatacattgtggatgccggcttcatcactctgaaaatagagatgtttccatctgctggtaggcttttttcaaggattaaggataaaaagattgcatcacatgaaatgtgatgttcattttatttccttcttttggaaatgtaagctgacatgtgtgtcttattactaaagatctgatgcatctcccaggatcctataagagtttactgtcaaatgggcatggcattataacacatgtgcataaacccacaggcatgtacataaacacataggcatgtacacacactgtaccgcaaggtaaaacaacagccgttactgtaaaacagtgagagacaatagccttacactcctcttgaaatgaatcaatgaatagacatttgttatgaaaagatagaattcaaaggcaataccagccatataggaggtacagacatagacacggacataatgaaatgtgaaagaaaacataaaaactcaggacctcaattcactcttccaaaaggaaagaacaaggtgaaagtcgaatcatgcaagaagatgcctttcctttcattcctaagcagatagctacagataaagggttaaacatctccacaggtagctacataagctaggttcaccttatgcaaagtgctaatttcctaaacatgagacaaatatatgcttgactactgcccctcttgctccctttctcttgcaatttcgattcagtaatgtgaccatacctgccctttttcccttcaagcccacttctcccctttaaacactgaaggcttcagaatcatctttggagaatggcacagaccagagactgtttctctgattccatgtttattccttctgggcatgtccttaaccttggcaaaagaaacttctaagctgattgggatctatgtcaaatactttttggtttacagaaacttgagcaggtttgaggaatagaaaattgtccagtctgccaggaacacacagaaaatgtgcaaggaagaagtaagaaataacactagaagtggaggtcatggtaatacagttggggatactggatgcccagctaagaaggttgtggaaaattcatgccttccaagccattgaaagtgatttgtattgctttgttgttgagaatgagaacaagaaaagccatgcattaagaaaacttaacccaatagcaacatgcaagaatgcagagagaccacttagatgtcaactgcaaaaatggaaatgaaagcgagtgtataagtctcctatttgctgctgtaacaaatcgctacaaacttactggttcaaaacaacaccagtttagtctggcagatatggaggtcagaagtctgacttgagtcttagtggactaaaatcaaggtgtcagcagggctatgctctacgttaggggagaatcctttttcttccctttttcagcttctagagatcttcttcctccatcttcaaagcctgcaaggtgcatctctctgtgccttttttgggtagtcaaatctcctttgcactctcttctttctccctcttccacttttaaggactcttttaatgacagtgaatctacctggatattccaggataaaactcccactttttaaagtcagccaattagcaacttttattgcatctgcagccttcattccccttgacatctaattaagtctgttaacatgttccagggattgtgatgtgcacatctgatatggcttggctctttgttcccacccagatgtcatcttgaattgtaatctccaggtgttgagggagtgacctggtggaaggtgattagatcttggggtgatttgccccatgctgtcttgtgatagtgggttctctcaagatctcatggtcttataagtggcactttctcctttttgactgtctcttgcttgccaccatttagacgtgtcttggttctccttcaccattcaccatgactgtaagtttcctgaggcctccccagccatgtggaactgtgaatcaattaaacctctttcctttataaattacccagtctcaggcaattctttatagcagtgtgaaaacacactaaaacaacatcctcagtgagtgttattctgtctaccactgagacaaatgtcctgattaagtgagattttcccagccttcctgttttgaggtaagcttttttctggctctcagaggaaccaaacaggggctggacccaaaagttaaaacagaaataaagcagtgcttctcagcatgtaattccatctttagctcatcagatcttagggcatttagcttggtggtaggcagaataagacccaccaaggatgtgcacgttgcaatccctggaacatgtgaatagacttggttagacatcaaaggggaatgaagcttgcaaatgcagttaatgttgccgattgtctcagtttgtgagcaccggatggctctccttgcaactgcatctctgtcttgtattcactactgctatttccagagggacccactcttcctagaatggactaggaatgtgtgtttccaaccaagacgctgtggagagtgccagagagcactaagaatgatacctgagaccagaagtgagagccagggctggcaaatgtacctctaccccaacccggaggagatgtaaagacagtagttcacctcttatctatgtgggatacattcaaagacctcttccccaacccactgtgtatgcttgaaccaggagatagtacataaccctttacatactacgtttttttctatacaatacatacttatgataaaggttaatttataaattaggcacagtgagagattaatagaggtaacacataataaaatggaacaattataacagtatgctgtaatgaagactatgtgaatgtgatctctttgctcctaagtgagtaacaggaaggtagcatgtacagcgtggatgtgctggcaaagggatgattcctgtccctgcggccacagagcaagatggcgtgaaacttcatcatgcttctcataacagcgttcattttacaacttatgcattgttcatttctggaatattccttttaatatttttagactgtggttgaccgcaggtaactgaaactgtggaaagcaaaaccaaggataagaaggggctactgtaatgattttagaaagtgggaaaaataaatttactaagggagaatgatactacagacaaattggcaccatggtgttatttttttccagaaacatctagctcaggtgagttggtaggcggggttgaagtagaattgaggttgcatcctgttatcagagaaagaaccagagcactaaaggtgtttgcagggtagtattgtggtttccaaccaagacattgaaataaaagtggtttggtccatgcgtctgcacccagatggcacagtgaagaccctagagaaagtgagttggaaggacccagagtcttagtgaattctgaaagccactattccagatacagtgatgacagcaaatgtaggtatgatcactgcagggaagaaattgagagaagtgaagataaggcgtgtttggagttcagtaggtcaaagatgacttaatagtatcatgcacgagttctataaacttcaaacctattagaattttaattacccaacttgaatatcctttgcatgtcgtcattttaaagttggctaaaagaagtcataaaaataacgtaatgcatttgtacattactggagagggaagaatctgttttcttcattcctctggcatttggagcagacacagtttatgatttggctgtaagtatatcttaatatgcatggaagaagatatatttttcttcatgaaaatatataaatttaaaatgactgcagtgacacttcggatcacaaaaataccttaggagggaaatcttgttaaatcattttctgcttttactttttggttgtgccttcagaaataaaaaaaaaattgggatagttggggaggaaaggggcaaagtcaagccaaaaactaatcaaaaatagcaaagaatgatgaaaatccagtgtttggattccatttgcaataagtgaatgcacatgaactttgacacttccagtctttggagaaatagttttgctctcagtatatttttaatccaggaggcaacaaaggcaggaatgtgtgaatctgtctagtttaattctagtttaattcttcaaatataaataaaccctgtggttacaaggacagttttgggaggcaagttgcttcaggtggtataatcaaaatggagtgttattaaaagattaatcacagtaaatatttcctcacaggatgcagtagctaaatctcactaagaccagcaagtctgctagcataggcgtaaatgcctccttcacagacaaaattttggagtgctcagggatgcttaagggtgagctcagcctactttagtggttccaggtcagccctgtcagactctgtctcttcttctccaccccctcattcatggattccacacccagaacccatctcagaagcagaatcctgtgccgtcccccaaatctgacacatgccctccagaggcctttcatccatgggacagaaattgaacccatgttccattaggaccttgagattgtctcatttactttcttgcctggacttggctctttcattctacacaaagcaaaaccatcacttggaatccccactggaccacaaacaatggatggtttatcagtctgcttgaggcatcataataaaatacccaaggctggggagcttcaacaacagacatttattttcccaccatcgtggaggatggaagtccaagatcaaggtgtgggcaaggctggttgctcctgaggcctctctcctgggcttgtagactccgtcttctccatgtgtcctcctgtggtcgtccctctgtgtgtgtgtgtgtgtgtgtcctcatctcctcttcttatgagatgtcttagtccattttgggctgctgtaacagaataccatagactgggcagcttaaataagagacaggcctgagacccaggagagccaagggtgtgagttccagtctgagtctgaaggcctgagacccaggagagctgaaggtgtgggttccagtccaagtggagaggcctcagctccagaagggccaatggtttgagttttagtctgagagcaggagaagactgacgtcccagctcaagcagtcaggtagaaagagtgaattctcccttctttcttctttttattatatttagaccttcaatggattaaatcatgcctatctacacctgtgagggcaacctgcttcacgcagtccaccaactgctaatcttatctgcaaacattttcacagacacatccagaaataatgtttaactaaattctgggcactttgtagttcagtcaagttaacccataaagttaaccaccacatcaagatgcctatttcattgaatctctgttatttccttccttctcttccttccttcctttctccttccctttcttccttccttcctccctttctccttccctttcctccttcctttctctctcccttctattcttccttcctcccttccttccttcttttctttcttccttcctccctttctttcttcctacctttctccctccctttcttccttccttccttcctccctccatctcttccttccttccttccttccttccttccttccttccttccttccttcatttcctctatagctactaagcttctactatgcctcagacaccacattgggaacataagacagacagtaacatagttcctgctcttgaatctttccaatgcattccacaagagagatttttcagtttgtgtgtgagtttttaaaattagatgtattttctaaaataaaacccacgaattcaggttccgggttggggggaggggaagccatctgggtgcacagaaaaataaggccaatcttctgttggcaagtatggttgaccctctaacaatatgtgggttagggccactgatcccctgcccagtcaaaaatctgcacttaactgttggctccccaaaacttaactaccaatagcctactactgattggaagccttactgataacataagcagttgattaacatgtattttgtatgttatgttcattatatactgtattgtttcaataaagcaagctagataaaaggaaatcataatgaagggaaagtatatttgctattcattaaatagaagtggatcaacataaaggtctttatcgtcaatgtcttcatgttgagtaggttgacgaggaggaggaagaggagaggttggtcttgctgtctcagcagtggcagaggtggaagaaaatccacatattagtggacttatgcagatctaacctatgttgttcaagggtcaactgtacagataaagtcatttcacttgtttccagcagggatcattctgttttggagatgctcacatcctcattgatcaagagcccaggatatactttgaatcctcatatttgcaaagactttgcataggatttcagaaacccacaggtcctaggattgcagtgtgtaacaggataaccactaatggcatgtagctatttagatttaagtgacttaagtgaattaacattaaataaaataaaaaaatccagttccttattcaccactagccaccatgttttcagtgttcaatagcagctagccagctattggactgtgcagattatagcacatttccatgactgcagaatgttccgttggacagaactgcttcatgacctggagtatgaaggtgaaccccagacaccaggtgagtgatgtctgggtccgagaatgtttaaagctcttccaacatgctcaagcttcctatctctaacctgagtttcagcaaaccaaaacagatcatgcacaatagcccaattaatgaagggaaagacagaatttccccgtcattggccacatgacatctcctcatgctacacctacaatctttgtattttacgggtttctatccatatgcaagacagatattatggcaagacattggggacagaacaacctccacaggtctcctgtctctactcctcctgtcaatgtttgttttgtatttttacactgccgtgctctgtttctggttttaagagttcagatagaggttaggcgctgtggctcatacctataatcccagcactttggggggtcgaggcaggcagattgcttgagcccagaagttggaaaccagcctggacaacatgacaaaaccctatctctacaaaaaatgcaaaaattagccagacatggtggtgcgtgcctacagtcccagctactcaggaagctgaggcgggagggtcacctgagcctggggaagtcgaggctgcaacaagccaagatcatgccactacactccagcctgggccacatagtgagactgtctcaaaaaaaattaaatcaaattaaattaaaaatatttaaaaagggttcagatagataattcctgaagctgttaatactggaggtgaattcctgggtactaaaggtcaatgcctctgagctatgtcagcttaagtgtgtggttttacctggttaagcctcagcttctgcacccctttatctccccgaaaaaaatggggatgaagataaaaacacttcctggggttgttgtaaatagcaagtatctaatagagctttcagaacacagcaagtgctcagtaaaagtttgatgacactttgtaaatacacttggttttctctataggacctcaaaaacatccctgccagattcctctcttttaaagaagaggaatttttctttaaaaaaaacaaaaacaaaaacaaaactcttatttttcttttttaaaaaaactcttattttcagtacacatgaaggtttgctacataggtagacagatgtccatgggtgattcttgtacagattgtttcatcacccaggtattaaactcagcacccaataattatattttctgctcctctccctcctcccaccctcccccttcaagcagaccccggtgtctgctgtttccttctttgtgtttataagttctcatcatttagcccccatttataagtgagagcatgtggtatttggttttccatttctgtgttagtttgccaaggataatggcctcccgctggatccatgttcctgcaaaagacatgaactcattcctttttgtggctgcacagtattctttttctttatccaatctgtcattgacgggcatttaggttgattccatgtctttgctattgtgaagtgttgcaatgaacatttgcatgtatgtatctttatggtagaatgattttaattcctctgcttatatacacagtaatgggattcctgggtcacatagtaattctgcttttagttctatttatttatttatttgagacggagtctcactctgcccaggctggagcgtagtggcacgatctaagctcactacaacctctgccttgcgggttcaaacaactctcatgcctcagcctcctgagaagctaggattacaggcacccgccaccatgaccagctaatttttgtattttttgagtagagacgggattttg[132 bp omitted]gctctccacaatggttgaactgatttacagtcccaccaacagtgtgtaagtgttttgagaagaggaatttttcatcaagagtctgatctgggtttttattcaatgttctgctttcccattctttgctgatggatgtgagctagagccagctaaaggttgtcaggtaaaaagaaaaacattgccattgcattcgcagaattttaaaggatgctcgtcactgagagacaaggtagaaggatgacatcacacatgaatgcagttttgcaacctgaccctgggtcttggaagctgcaattgttgcaagtcccatgtgggtagactaggagataacagggcagccagttagttgtgcagcatgtcagccatggctggtgctacgagggaatacaatttaaaatgtcatttgttaaattctgtttgttaggaacctggaagggctcaattgacactgtgtctgaatgggcatggattctctttcattataagagtattttggcccggcacggtggctcacgcctgtaatcccaaccctttgggaggctgaggtgggcgaatcacttgaggccaggagttcaacactagcctggccaacatggcgaaaccctgtctctactaaaaatacaaaaatcagccaggagtggtggcatgcgcctgtaagcccagctactcaggaggctgaggcaagagaattgcttgaatctgggaggcggaggttgcagtgagctgacatcacgccactatactccagcctgggcaatagagcaaggccctgtctcaaaaaaaaaaaaaaagtatttgtaacagcacaacaaagatctcatgaagccaccatgataataattgtttgaaaagaaaggaattcaccatattcctattttaaaggaatactttgactttgtttcttgagaaaaaaacaacagaattaaaaatagcacatcataaggttaaaacatcacaatacttttcttggatggctggaaaaatagattgctaaacaaacaagttcaaaaattgtcattttgtcccatgactgggtattgacccaaagagaaagaaatcattctatcaaaaaattacctgcactcctatgtttatcacagcactattcacaattgcaaagatgtggaatcaacctcagtgtccatcattgaatgattagataaagaaaattactcagccatacaaagaaaagaatgaaatcttgtcatctgcagcagcatggatggaacaggaggctgttatccttagtaaatgactccgaaacaaagagtcaaatattgcacgttctcactgataagtaggagataaacaacttgtacacatggacatagagtgtggaatcatagactttggagcctgggaaggatgagagggtcaggggtgagggatgagaaattacttataggtacaatgtgcattatttgggtgctagatacactaacggcccacactttaccactacataatatacccacgcaacacgatgatccacttctatttaatgaatagcaaatatactttcccttcgttatgatttccttttatctagcttgttttattgaaagaacacagtatataatgaacataacatacaaaatacatgtcaatcaactgcttatgctatcagtaaggcttccaatcagtagtaggctattggtagttaagttttggggagccaacagttatgtgcagatttttgcacttgtacctcctacatttatatgaattttttagaaaattattattttaatagatttggttaacaagaaaggcacactaaggagatttaaggtttcatgtatgcttgtatttacatattcaatgcacaatttatacatatttaagacattatatgctttataaattataacacatgcaatttaatatacttttttttttgagacagagtcttgctctgttgcccaggctagagtgcagtggcgtgattactgttcactgcagccttgatgtcccaggttcaagcaatccttccacctcaccc[132 bp omitted]tctcaacctcccaaagtgatgggattacaggtgtgagccaccgcctataggccaggcactgtggctcatgcctgtaatcccagcactttgggaggcagaggcgggtggataacttgaggtcaggagttcgagacaagcctggccaacatggcaaaaccctgtctctaccaaaaatataaaaaattagtcaagtatggtggcgcacacctataatcccagctactcaggaggctgaggaatgaaaatggcttgaacccaggaggcggaggttgcagtgagccaagatcgtgccactgcactccagcgtgggcaacagagcgagactccatctcaaaaaaaaaaaaaaaaaaaagaaaaaagaaataattttatatatttaatctacacttaacattttaaatttagatttttagtaaagcattacaattcaaagagaaaagagtactttatttttttttaatctgctcttagcagaagtcaaaagcaacaagaaacgatgaaaatgctctttccccatcttggcactgacgttggactttatgaacaactgctaagagaatcattttaacagaatatttccgctgaaatgtcagcattctttggtcttataatttgtgtaacgagatatatattataaacacagcatcctgcatttcagaaaaatcacaaagtagcttcagatggtgtccatggggagaaatggggagctccagggagcccaggtggaaatgaggtgggtgttgttttgtgaaggagatgagtttaaactcatcattcacaagctttcatgtctgaatgtagaagttacaaagtgatattgtttttatccacacacattacaaattcaaggaagccctggctttttggtaagaatgtaagaggtacaagtgcagttttcttgcatgggtatatttattgcacagtagagaaatccgggcttttagtaaacccaccaactgaatagttaacattgtacccattaagtgatttctcatccctcaccccccctaccctcccacccttctgagtcttcattgtctattattccattctctgcatttgtgtgtgccccattattcagctcgcacttataagtgagaacatgtggtgtttgaccttctgaattgtttcacttaagataatggcctccagttccatctatgttgctgcaaaagacatgatttccttctttcttctgtatggaaagaatgtgttatgtattaaattgcatgtgttataatttataaaccacatataaattgccttaagtatgtataaattatgcattgaatatgtaaatataagcatacactaaaccttaaatctcttcagtgtgt[136 bp omitted]catggtaaaaccctgtctctactaaaaatataaaaattagctgggcatggtggcggtgcctgtaatctcggctgcttgggaggctgaggcaggagaatcacttgaacctgggaggcagaggttgcagtgagtcaagatcgcaccactgcactccagcctgtgtgacaagagtgaaactccatctcaaaaaaaaaaaagagattaaattaaatttcagctgggcgcagtggctcacatctgtaatcccagcactttgagaggccgaggcaggcagatcacttgaggtcaggaattcgagaccagcctgacacacatggtaaaaccctgtctctactaaatataccaaaattagccaggtgtggtggtatacacctgtaatcccagctacttgggaggctgaggcatgagaatcatttaaacccgagaggcagagcatacagtgagccaagtttgcaccactgctctccagcctgggtgacagagcaagactcagtctcaagaaaaaaaaattatataaatttaggaagtacaagtgcagtgatgttgcatgggcatgttgcatagtggtggaggaggacttttagtgcatcgatcacctgaataatctacattgcacctataagtaatttctcatccctcacacacaaccctcccatctttcccggtctccagtgtctattatcccacactctatgtccatgtgtacacattgtttatctcctacttataagtgacaacatgcagtatttgacattttgtttctgagtcatttcactaaggataacgctcctcattccatccatgttacttcaaaagacatgacttcattcttcctatggctgaagagtagttcattgtgtattatatatatcccacagtttctttctcttctcatccactgatggacacttaggttggttccatgaatttgcttttgtgaatggtgctgtgataaacacacacgtgcaggtattttttggtatgattttttttcccctttgggtagtgggattgctggatcaaatggtacttctatgtttagttctttgagatggctccacactattttttgtagaggttgtactaatttacattcctaccaacagcatataagctgacgttcctccagggtgtgtgtttttataagctagaaaggtaattgtgtgtttgctgaaaggcctccccaggagaaatgggcttccaacatccacggaagcagtagggtttgtgtctacacaagtcaacgagccctctctggtgctgcagcttggacagatttaggcatgaaggggctgctgtaatttccttcaaggtcagagtgtgagttggaacagagtcaagaattttcagggggaaagaatcataaatcaacccaggtaatggcttttgtctttccacataattggaaggcaaacccagcactcatgataagcactgtgtggttaggggaccctcagagatgagaaaagccagatgaccgggttctcttctgtcaatccgagtgagttttcttcatctgtctaaggctggaggcgtgtctaagcccacaaggatgaagccaacctcacgactcaggaaaagagtgaacccaaatcgatcatgcatgtttgcaagtcaagagatcctggctctaaaacgagtttttttagttacctcaaagactgtgggcatcagataagctcagtattgggcaaatcattataaacatttctggtacagaaatctaaggagctaaagtaggtcatacctttatagatatcttgttccaaaatcactttatagggcctgaattaagcttgctaggaggtccctataataggcatgcagtcctgtgaatttccatctctgtttttctcttatgttttgctgtgcgatctttgctaagtttctgtgccttcattctctctgtgtgtgtatgtgtgtgcatgtgtgaaatagttgttcaatttcatttacttcacagaactttgtggaaggttaatgaaacaagttgaaaggcatctgctaaaattctgaaacaatgagttttaaatgagtggatcactcttactattttgttacaaatctgctagatgtgggtctactgtgataaagtaagaagagctgggactccatgagcaataatgtatacaataaaatgtgtttagcagattaactgtagtgaatttgggattggctgcttgacccagggaaggaaaagatacaggtatccctcctgctgtcttatgggatgggaagggactatctcatggtaggccataaataactatataatggaggatcaattttaccagggcagttttagggattggaaagctgctgctatagagaaatggaaagaaatggaggatggagagatagaaggaattagaggattttttaaatcagtacattaaagaccttacaatgtgaaaaggaaatgctttgttcctgaatccaagtgcctatgtcagttatataaggaaactgaggcatcattttactctgttacattaggtctctgaaactgctgagtcttcagctgagacagttctgagtccaagtcaccatttgccaatgttgatgatgattgtgatggtgatgatgatgatgctggtgatggtgataatggtggtggtggtggtgatgctactgatgatgatggtggtggttatggtgatgatgctgatgatagtcatggtgatggtggtgatgatgatgatggtgatgatagtgctggtggtgatggtgatgatggtgataatgatggtggtgatggtgatgatgatggtgatgatagtgctggtggtgatggtgatgatgatgttgatgacagtgatgatgatgatggtgatgacaatgatgttgatgacagtgatgatgatgatggtgatgacgatgatgttgatgacagtgatgatgatgatggtgatgacgatgatggtgataacagtggtgatgatgatgatggtggtagtgatgatgatggtggtgatgatgatggtgatgatgatgatggtggtggtgatggtggtgatgatagtaatggtgatgatggtggtggtgatggtgatgatggtgatgatggtaatggtggtggtgataatgatgatggtgatagtaatgataatgatgataatgtgataatgatggtggtgataatgatggtgatgatggtgatggtgatggtgatgatggtgagttatgatggtgatggcaatggtgatggtggccatgatgatgataatgatgattggtagggtcggcttgtcacttgtttagtttccacgtctgaaaaagggagtctggatctgattcttctaatgattggcctcccatcctcctgtcttgctcatcttcagggtccctggagaatcattctgccccagtggccactgcttgacagattccacatgggccaggcttgttttaatgctaaggcctgaaggaaatcaaaatattttacaccaaaatatacttctttgacatattttgggatggcagtcagagggacagcaaacagaagcagccctgcaaagctgtatttagtggggagatttgcacctgtagagaatcagcattgatgtaaacaggccttttctgaggacttaccttgtctgggcctgaaaaagatgaactgagactctaatactctcaagtcgcaatgaaacatttgccatttattctctcttggggctgttacctgtgattttttcatctacataacatgatcctctttgctagccagacctcctcttctccctctcccataacctgcctggccatcataacctgattcaccactataaccggtttttgaccatgatctgagtcccccttctttctgtaacctcaagatggtgtgtaagcttctacacttcattgggaaattggggtcatcactctgtgattctcctccatgtgtccatgtgtaagttaatatatttgtatgcctttgctcctattcatccaccctttgttgatttttcagtgaaccttcagagggcaaaggagactttttcccttggcccctacaggctccagccagggagaggccctgggctcttcccaatgcctcctgactcagatgtcgcaccaagccttggatcgtgaatcttattttcccaatggttcctggaggaacctggggatgctactcaaaggatggacttaactggccacagggcaacctttggccaaatggctcaggagatggaaggaaattggtgggaaaaactctactttccacccccatttgttggaacatcgcaggtgcaccgtgattccaaagggtcttctcaagagacaacacagtcagctgaattatctacaaagccagggacagatcagggcgccctccctcccactggctttcttgccttctttcccagcactttcccctcttcctttattcctgtttccctgagatcaaaatctccaccacttccccaagggtactgttttctagagaggccaggcagtggcacaaatgaatagtggccactatcataggtcataaggattaattgagataatatacacatagtgcttctcactatgtctaatccattgtaggttctccggatcttcgaggccatcagaaggatctagaatctgtgtctgggaatcgttttggcttttgcgagttgttttgcatcatcttattatgttctaacagcagcaaacagttaatagagctgaccactgagggaaggttgttacatgaaccaccttgaacagacaaaaatgatctcctgagaattctattctagctacctgaacaagatgcaccaggtaggaaaaaagatatgcagggaagtacctgaggtgttcaagtgcatccatgttcaacttgatggtttgataattttagctcagaccaacacaggtcatatggtatccatgaacatcatcctggaaggaacttgaaaagcagaagggccgtgactagcatacttttttaagctatttgaaagagctgatggtaaaccatgtaggtcttggccaatagaccagggtggacaaaacctctttatagacaacgaggctcatggttcagaacaaggactccatgagtcattacagaagagaaattggatgacactgaaatagtctattgatagtagctgggagggtccccaccacagcatacgaaatgctgtgggcttcactcccactcacttccaggaatgtgtctactcttggaagagagaaaagaataaaagccaggaagaggaaggaggccatatttcatgtcctggaatcactcaacactgtgaacattaatccatgaagtaaaacaaaacagtacaaaagatgaccatattcctgtagtttaaaaatgtgtctgagccattgagtaaatgcttttgatcaaaattttagtcatttgccaattgctgactaatctgatgaaaatgaagcattctgaaggaacatgcataatctaaaaaacagtagtattgaaaagaatcaagactattcttaccttaatttttaaaaagtattaaaaattatttgagaggcgatggaaagatggtctttgtatatttatcttgaaactgctacatttgcaaacaaatcctttaggctcaaggaaataataataaagcattaaaagcaattcaataccagtcccaaattaaactcactttaagagatatcagttaggaatacaaatgcatctgttgtaggaaaattaattcagcaccatttgcttagcaaaagatgtgattggccctaaactgaaattattttaaaaaaatgtattttaagacacaaatctctttaagtgctttgatgaataagaaatttcgcaaaagaattgtgatatggtttggctgtgtccccacccaaatctcatcttgaattgtagctcctacaattcccacatgtcgtggaagggacccggtgggaagtaactggatcataggcacgggtctttcccatgctgctctcatgatagtgaataagtctcacaagatctgatgggtttataaagaggagttccccagcacaagtcctctctcttttgcccgtcaccatgtaagaagtccctttgctcttccttcattttctgccatgattgtgaggcctcctcagccatgtgaaactgtaagtccattggacatcttttttctttataaattacccactcttgggtatgcctttattagcagcatgagaacggactaatacaaaatcattctactctaggctaaagcttcaataattgtttaagtctaacatgagaaggcaggaccaacaagccaagtgatttaggagaggtccacattcttctttccatttggagagaaatgtagtaataaccaccccaagcgagtgctgggcatgggtcaggctggggttaattgcatcacagcaagtaccacttattctcatagccattggcaagatgggtatagagttcctgcttttcagttgataaaacttaaccatgaatgggatacgtaagtgttcaagatatgtggcatctcataagaagccaatgtatgcaaatgcacatagcagggaaagattatattctcccggaatctgaaaatgtagtcccaagtatccccttgatctgtgccagtgtaggtatccttgaagtttcaccttatcttttattgatacttattttattttagattcagggggtacatgtgtaagtttctgacctgggtatattgcatgatgctgaggctggggctcctaatgaacctgtcatccaggtagtgagcctggtacccaataaatacattttcaacccttcttctcctctctcccttcctgcttttggaatccccaaggagattctcgctaaggagagaggacttaggaggaaccagcgcttcccacaccttcatctcagacttccagcctccaggacagtggggaaataaatttctgttgttcaagccacccagtctgtggctctttgtcatggcagccctaggagatgaatacagcccccttataaacagcaacttcctgtgcatcctgcttaaatttccaccaaccctggacacacacacacacacacacacacacacacacccctaatggaaggggctgttaatgcatttttggctcaatatttaactttcaggacacatatacttggccaacttcaacaccacccaggactcttcattcctgtgcaacaggctatggtcccatgattctcaccttctccaaatccctctgggtaggaagaattctctcaccatcttccactcagttttctccttgaagttcccaaaatatccttgacttcttggccctgcttgtctctcaggggagaaaaagttggtcaccgccaaagaaaacagccttggtaggacttcctgacaacgccttcaagtgcgttttcattctacaactattcaatcatcagctaactgctccagacaaaaggagggcacttttgaatgaaaataagaaatacgtaag[212 bp omitted]gaggcaggagaattgcttgaacccaggaggcagaggctgcagtgagctgaaaacatgccactgtactgcagcctggacgacagagtgagactccatctcaaaaaaaaaaaaggaagaagaagaaaagaaaagaaaagtaatgtatcttctccctggggggagggggggaaatgcatgtatgtgtgtgtgcgtgcgtatctgcgcacacgtattcagttagaagacaagcatagacccattgtaggggaaggagaataccactcaaacctgggaggagtcatctgtagtgtagtgtactgtgttaccttgtgttatcttgtacattgcattatattttgcatgttattgtattgcattgaattgttaaagcttaatattgtccttgacatgtggaagaaaaagaaataggtggatttaactctgtctctgtctttcactcacacaggcgcgcgcacacacacacacacacacacacacatacacacgtaatgaacactcaattgttctataacacttgtttggaaaacacaaatgggttccaatgcaattgacatatgagggcacacttgaacatactgcacattttgcactggattttgcataactttctccacacacaaaaaagtaagacaacatcaacaaaaccacaggtgagcaaagagaattgcattaccagaaaacttcacctgaataaagaaaaagcacacatttccacacctcaaacatatacccacttcctcagtttacaggtgtcttaggagcagcatgcacccattcctgaccagggtgaaaactgcccatccatttttagacaacctgcctgttttactgcattcaggctgctataacaaaataccacagtctgagtggtttaaacaacagacgtttattggtcacagttctgcaggctggaagttcaagatcaagttgtggcagattcagtgtctggggaggattggctttttggttcatagatggtgctttcttgctgtgtccccacatggtggaagggacaagggagctctctgggtctcttttataagggcgttaatcccatccataaggcttcaccctcacgacctcatcacttcccaaagatcccacctcctaacaccagcaccttgggggtgagggtttcaatgcaggaattttgggggtgatacaaacgtttagaccatagcactgccttcctcaactttacaatatctcccaagtggctacacttctgaggcccatgtgcaccagccaatatcaggtctttttctgggtaaggtctgctgacatatattgtaaagtttacatatgccttaacaaataagcacatgcaaaactgttaccattttaacagtcttttatctccttgtttatttatttattcttttttttttctttttctttttgagagagggtcttgctccgtcacccagactgaagtgcagtggtgtgatctcagctcactgcagctttgacctaccgggctcaggcgatcctcccacctctgcctcctgagtagttgagactacaggtgcgccccaatatgcctggctaatttcatgtattttttgtagagacagggttttgctatgttgcccaggctggtctcaaactcctgggttcaagagatcaacttgcctcagcctcccaaagtgctgggatgccactgcactggaccctatttattcatttttaattgacaaattgtatattctttgcatcagtgataacatctttgagggctgctccacaccacggtttttccataagccctgtggttattactgagtgttttttgcatagcacagtgatttaggggaacacatctgtccccttaatgcagaatggactataattaatgagggaagaaaaagagtgggattgagtttctagatccatcttgcagacgcagctgtggttcttccgccatgaccttaacgaggaaagagaacaagtactgactgagttctctagttccctttcagattgtgtgggccctcgagctgttctcctcagaaccagggctgagtatgtctaagaatgtttgggaagatgatttaaagcaggtgccctcaatcaggtatggtttatttattttatttcaataagtattggggagcaggtggtgtttggttacatggataagttctttagtggtgatttctgagattttggtgcacccatcacccgagcagtgtccactctacccaatgtgccgtctttgatccctcaccccactcccacactttcccctgagtcaccaaagtccattgtatcattcctatgcttttgcattctcatagcttagctcccacttatgagcgagaacatatgatctttggttttccattcctgagttacttcacttagaataatggtctccaattccatctaggttgctgcaaatgccattatgactgagtagtattccatggtgtctatctatctatctatctatctatctatctatctatcacattttctttatccacctgttgattgatgggcatttgggctggttccatatttttgcaattgcaaattatgctgctataaacatgcgtgggcaagtctttttcatacaatgccttcttttcctctgggtagatacccaggagtgggattgctggatcaaatggtatatctacttttagttgtttaaggaatctccacattgttttccatagtgggtgtagttcatttaaagctggtgggaaaaatgaggtgtgatctagttacagcatgcggcgtcaatcaggtgtcgcttatttagagcattggggtcaattagatgtggtctatttaaaagaggtgtggttccaagaaaatcagataaatcagatgtggtcaatttaaagcaggtagacttcatcagttgtggttgatttacagcatgtgggggtcaattgggtgtggcctttaaagcaggtgtgtaccaatcaggcatggtctatttaaagcaggtggaattgatcaggtgtggtttatttagagcatgtagagtcagtcatgtatggatgatttaaagcaggtgggataaagcagatgtggtctgtttaaagcagtgggattgatcagatgtgtctacataaagcagccagggtcaatcaggtgtggtgtatttaaagcaggtgcaatcattgagatgtggtctattcaaagcaggcagggttgatcagagatggtgtatttaaagcaggtgggattaatcaggtgtggtttatgtagcgtttatgtagagtcaatcaggtatggatggtttaaagtagatgagataaagcaggcatggtctatttaaagcagttgagataaagcaggcgtggtctatttaaagcagttgagataaagcaggcgtggtctatttaaagcagtgggattgatcagatgtgtctgcataaagcaggcaggatcaatcaggtacggcatattggtggaatcactgagatgcgggctattcaaagcaggcagggtcaatcaggtgcggtctatttaaagcagatgggattgatcaggtgtggtttatttagagcatgtagagtcaatcaagtgtggtgtatttaaagcaggtgggataaagcaggtgtggtgtacattaagcaggcagggtcaatcagggatggtctatttaaagcaggtgggattgatcaggcgtggtttatgtagaacatgtagtcaatcaggtatgggtgatttaacgcaggtgtggtctacattaagcaggcaaggtcaattaggtatgctctatttaaagaaggtgagatatagcaggcatggtctatttaaagcaggggaaataaagcaggtgtggtctgtttaaagtagtgggattgatcagatatgtctacataaagcaggcagggtcaatcaggtgcggtgtatttaaagcaggcggaatcgctgcgttgtggcctattcaaagcaggcagggtcaatcaggtgtggtctattttaagcaggtgggattaaacaggtgtggtcaatttagagcagataggttcatagagagatttctggcccagaaacagggatgaggtgtatcctgttcccagctctgcataattgataaaaatccatccaatctctagacagcacagatctgtccgtactcctagaagatttgatgcagtggcctacacaaaatacacaggccccagttgagctctgaaattctcttctctccagagctcctcctcatcctaaatccacttctgctcagaccttggtctccaaacccgagatctctcttctccttccatgcaaataactattttttgttttcggaaaaggaaatacttgaatacgctgttgtggcggtggctgctcttctacaggcacacgatttcttcttcatgaagacctctccctgtgaatgtgtgaagctgatttcagatgagcgcagagtgtgtttaattaaggtgcttcctttcccggccagcgtgcgggacccaggagccatgtgcggtagctcgctggccgggctctcatctccctcccaagcagagggcggtggacaccaagcagtgggatgtccgcagccaggaaagcttggggaaaaggctctgtctactgccagggacgaggcttcctgccggagtctcaacggactgtggacgccacatgggagacggaccacggtggcgcgtggtagcatcacggccgctttccacgctgcggcttggagtggtccttgtttagattcctttagggaggttccggaaggagctggacgctaaagtgcggttgtgtgtccagtaggcttgctggacgatggtgtggacggtcatagaagagctttatgttttccaggtagagaatgagtttgagagccaggtagggggtggctccctcaagaaaggggagacagggcctctgatggtcacagggctgggtgtatcggcggcatgtgggatccagttcatgtaaggagggatgcggctgtaagtaggcctgaagactctgaaagtactgttccccttagcaaagatggtgagtggctgggtgtgggtgtctgtgtgcctcggtgtctgttctgtgtgtatctgtgtggtttggtgtgtgtatgcatgtgtgtatgtgtgtatagatgtgttctgtatgtctgtgtatatgcccctgtatgtctctgtgagcatgtatgtgtgcgtcttgtgtatgtgtgtgtctgcatgcatgcacatgtgtgtgtgtattcttgtatgtattcatgtgtgtctgtgtatgggtgtgcactgtaataggtgtgctgtgtgttttacatatgtctctgtgtatacacatctatgtgtgtatgagtatgtgcatatatgttctctgtgtgtctgtgcatatgtgtctgtgatacaggtatgtgtgtatatatatatatatacatgtctctgtgtgtctgtgcctatatagatgcctgtatgtgtgcccaagtgcgtctgagagtgtctgtgtctcgtgtgtctctctgtgtatgtgtgtctgtgtcctgtgtatttatgtgtgcacatgtatgtatgtgtgtatgtttgtttctgtatgtattcatgtgtgtctgtgggtaagtacgcattgtgctagtgtactgtgtgttttatgtgtgtctctgtgtgtatgcctgtatgtgtggatgagtatgtgcatatgtgttctatgtatgtctgtggttttgcatatgtgtttgtgtatatatgcatgtgtgtatatatgtctctgtgtgtctgtgtgtgtatgaagatgtccgtgtgtgtacccaagtgtgtttgagtgtctgtgtgtttgtctgcctgtgtgtctctgtgtgcatgtgtttgtctgtatatgtgtgtctgtatatgtaagtatgtgtgtttctgtgtgtttatagatacctgtgtatgtgcccaagcatgtctgagagtgtctgtttgcctgtgtgtgtgtgtgtgtgtatgtgtgtctgtatatgtaagtctgtgcatactgtctgtgtatagatacctgtgtgcccgggcatgtctgagtgtctttgtgtgtgtgtgcctctgtgtgtgtgtgtatgtatgtgtgtctgtatacgtaagtctgtgcacgtctgtgtgtgtatagatacctgtgtgtgtgcctcagcatgtctgagtgtgtctctgtgtgtgtgtgtgtgtttgtatatgtgggtctgtatacgtaagtccgggcacatctgtctgtgtgtgtatagatacctgtgtgtgtgcctgggcatgttggagtgtgtgtgtgtgtgtgtttgttggtgtatctgtatatggaggtgtgtgcacatctgtgtgtgtgtttgttggtgttatctgtatatggaggtgtgtgcacatctgtctgtgtgcatatagatacctgtgtgtgtgcctgggcatgtctgagtgtgtctgtgtgtgtgtgtttgcatatgtgtgtctgtataagtaagtccgttcacgtctgtctgtgtgtgtgtgtgcctgggcatgttggagtgtgtctctgtgcgtgtgtgtgtatatgtaagtctgtgcacgtctgtctgtgtgtatagatacctgtgtgtgtgcctgggcatgttggagtgtgtgtctgtgtgtgtgcatgtgcatgcatcagtggctgggctttcactctaccctgggctactgtgatgaagcttgtggctggattccatgtgcacttgccctgctcacccctggaacccataagaagaaacacaagaggaggcggatgcttgcagatcagcgttacctgctgacgagtgagccccaggagatgagaggaggaaccacacgcaaggcggttcttaacctctaatgcttgagttgctgggacatgcagtccagctagacaaacgctgccttgcccacgagggattttcttagtgatgctctgtgcctggatgcatctgtctcaggcaggtacctgcatgtgagcccagcactccaggaggacgcacgggtctgcaaggcatggtccaaattccataactcaggacttcctagaagggtttaaggaggcagaggagtttggctggtttgttgttttcatgactcaacccactcattttaccagcaatcaaaacgagcatggattctcactgcacctgctcagcagagagggcggcatccaaaccagtggatctgcaactgtggcctctgcaacaacagcctcagcatcacctatgcccatcctagcaacaaagatccccagactccgctccagacccaatggagcagaaatgctgggggcttcacaatagccaagctatggaaacaagcaaagtgtccatggatagatgaatgaagaaagtgtgctctatgcacacgatggaatattattcagctttaaagcatttctcctttgtcctgagaatactgcccaggcagtgagatgcattttttttctaaacaggaaatgtgttaataaacaaagacgggaaaaaggagattctgtcgtttgccgcaacatagatgaacctggaggacattctactcgatgcacgctcgttgatgcagtttcttcatagtgtcattggtctttatattttggtgggtttttgcagtgactggtacctatttttcccttccatacttagtgcttctttcaggagctcttgcagggcaggcctggtagtaacgaaatccctcagcatttgcttgtctggaaaagattttatttctccttcccttgtgaagcttagtttggctggatatgaaattctgggttgaaaatccttttctttaagaatgttgaggctggg[131 bp omitted]gggtgtggtggcaggcgcctgtagtcccagctactcgggaggctgaggcaggagaatggcatgaacccgggaggcggagcttggagtgagccgagatcacgccactgcactccagcctgggcgatagagtgagactccgtctcaaaaaaaaaaaaaaaaaaaaaaagaaaagattgttgaatattggtccccaatctcttccggcttgtagagttcctgctgagaagtccactgttagtctgatgggattccctttgtaggtgacctgacctttctctctggctgcccttaacattttttcttcatttcaaccttggggaatctgatgattatgtgtcttggggttgatcttctcctggagtatcttaatgatgttctctgtatttcctgaatttgcaagttggcctgtctttctaggttgaggaagttctcctggataatatcctgaagtgtgttttccagcttgtttccattctcccatctccttctggtactccaatcaatcataggtttggtctttttatgaagtcccatatttcttggaggctttgttcattccttttcattctcttttctctattcttgtctgcatgtcttatttcagtaaggtggtcttccaactctgatatcctttcttctgcttagttgattcagctgttgatacttgtgtatgcttcatgaagttcttgtgctgtgttcttcagctccattaggtcatttatgttcctctctaaactgattattctagttagcaattcatcgaaccttttttcaaggttcttagcttctttgcattgggttagaacatgctcttttagctcagtgtagttttttattacccatcttctgaagcctactgctgttaattcatccatctgatcctccgtccagttctgtgttgtgatcatttggaggagaagaggcactctggccttttgggttttcagcattttttttgttattctttctcatcttcatgagttggtctagcttcgatctttgtggccgctgacccttggatggggtttttgtgggggctttgttgttgttgttgttgatgctgttgttgtcactttctgcttgtttgttttgctttcaaaagtcaggtccctcttctgtagggctgctgcagtttgctgggggttcacttcaggctctattcatctgattcacgcacatgcctggagatgtcactcaaggaggctggataagagcaaagatgggtgcctgctccttcttctgggacctctgtccttcaggggcaccaacctgatgccagtaggatccctcctatatagggcgtctgacaacccctgttggagggtctcaccctgttgggtggcatggggagcaggccccattgaacgaagcactttgtcccttgcttgagggggtgtgcttcactggggggaaattcactcatctgggcttctggattccttatagttactaggaggagagactaagtctgctggtccacatagactgtggccacccctcccactaggtgctaaggcccagggagatccaaattctgtccctgagcctctggatggagttattggagatcctgaaggaaagccctgaccattgaggaaggatgggtcagggttaggcctgaagaggcactctggccacagattgccacagccagtgtgttgggctgtggggacaagtattgggaccaagccatccagcctccctggctccaacagggggaaagcacagcctggagctatagaaatggatgacacccttcccctgcccagggagcttagcatgttaggcagtcacaatgctggctgctgcccctccgccaaagagctcaaagggcttagacagcaggcagcctagacagcaggcagccacagctggtgctggtcgcctctccccccaggagttcgctaggcttaagcagattccagctgagaggctgtaagaatctgcgtgttctggggttgggacactaggtcctggtggcatgggttttgggatcatgagtgggatcttccgatccatgggttgcatagttccatggagaaagcacagtttcccgggctgggtagcaggctcactcaccacctcccttggctgaggggaaggggttccccttccctgtgtgactctcaggtgggccaccacaccatactattcttccttctcttcgtgggtcaccccggccttctagtcaattttgatgagggaacctggatgccttggttgttggtgaaggatttgtatgctttttatggttttctcaatgggagcctctgaacgcggcagcttctagtcggccatcttggccccgcccccgcgtctttctttaatgaaacgttcgtgtgattggaagctgagaccatttagaaatattctttcctaatgtggatgtgaaaagtcgtgtaaagcctgtcattttattccttgagtgattgctgagggtgaagtagggttgggttgtgctttcactaaatacttttggtaaggaccatttaggattgggagttgtaccaagggcaccccttgttcttagcccttaggatttcgattgacttacaccacaggtgtattagtccgttttcatgctgctgataaagacatacccgagactgggaaatttagaaagaaaaagaggtttaatggactcaaagctccatgtggctggggaggtctgacaatcatggcagaaggcgaaaggcacatcttacatggcagcaggcaagcgagaatgagagccaagcaaaaggggttccccttaccaaaccatcagatctcatgaaacttattcactaccacgagaacagtctgggggaaactgcccccatgattcaattatctcccaccaggtccctcccacaacacatgggaattatatggcagctacagttcaagatgagatttgggtggggacacagaaaacccatatcaatcaccttatctaggtcttcaacttgtagaatatggtgggtgggacttagcctccataatcacatgagccaattcccataataaatatcatctgtatctatagctatagctatagctatagctgtctgtcctattgcttctatttttctggagaactctaacaaatatatcccttatcagatacatgataggcaaatatatcttttcattctgtggtttgttttttcacccttttgcctgtgtcttctgatgaacaaaagttgttgttgttgtttttggtgcagtccagtttacctgtttttttttttttccttttgttgcctgtgtctttcgtggcattgccaacaaattatcataaatttccaaaactttttctagaccatctaatatacatggagagtggaaaacacgagatcttgttgggcctttctccgctctggattttctggatgcagtcagccatccagacagctgagtgcaatggcgccttcgccccatctgtacctctgcagaaggtgggcccctgccaaaaagactgcattttccaggagggcgagagacaagccaatttggcaaaagcacacaagtgaagtcagtggctttctccagccgaccatctccactggtgttgctggctggcccttcacatccaagtggcttcaccggtaatatcctaagaatagcccaatgcattaaccgtcaacaatgccaaactttccaaggctcactttgagaaaatttcctgttttttcattatcttttccaattttttttctcaaacaaaagtctgtcaatctggcctcctgatgagagtctctttgtagctgcaagaggtcataatcagaaagtaagtgcctgcaaagataacatttttcaagaaggtgcttttttttttctcttctccagatggtgacatatggagaattagcagggatgctacaaatagcccatcagagggcttttggtggggggaaaggtgacagataaagccagtaaaggatctaagataccctcccaaatgtccacagacagggcagtttctcatccccacagctttcagctttcgcctgcaggttccagaccgctgatgtcagcccatggaaggattgaggcacagctgtctgcccagagtcccagagcacagcacagacatcttccaggattataaatcgagcagcatgtcagcagttctcatgcctaatacctgcaccggctgcttctatgggcccagggaaggacttatttctctgctatacttttatggatgatttcctggttgtggcaagggcttctgaggcatgcattcctcagttgccctaatcagataggtgcttcatgcacagtagttgtcacagtgacatttgtattagtctgttctcacactactaataaagacatacccaagactgggtaagttataaagaaaaagaggcttaatggactcacagttccacatggctggggagacctcacaattacagcagaaggtgaaggacacaaaggcacatcttacatggtggcaggtgagagagcttgttcaggggaattccaccttataaaaccatcagatcccatgagacttattcactatcatgggaacagcacaagaaagacccactcccatgattcaattacctcccactggctccctcccacaacatgtgaaaactgtgggagctacaattcaagatgagattttggtggggacacagccaaaccatatcaatatttttcctgttctaatccttagggagccaaattgtgttaccctgaaacctatctctggccagagagtgcatttataataaaagctatgctattctgggggagagaaccatccattcacctcctggcttggactttaatcatatgtaaaatttggaagcatggaactttctcagaggcttcaagaatctgtatgtgtttatctgtgcatttgagacagtataggcttttgagctacattcactggggtatcagtgaaaatattcaataaaatgttcatgctctgaagagaaatcctttgccattatccgtcgtgtcccattgatacatgtgacacacagatgtggatgtgtttgttgaatccattttgggacttgatctttcgctatttaagcaatctcacacttatcggtcagaattttagcttggtgaaatttttttctgttgaaagcctgtttgatggtgtgttgtaactcaggactaatttcaacattaacctcctatgtcttatgtcacccattcaaaactctctgttaccaacataaaaataactgccatttggatgcgcgatttactctataaagaaaggatgttctaatgagctggatctctgcattcttgttgggaattgcaacttagggagcaagaaagaatgcagaagaaaatggagatgagaggaaagagaggattgctttggaggacacacacagacacaagtacatatacaagcagacacaaacacatgcttacacttaaacacatgcatacatacaactgcatgcatgtacatatatacacacaaacacatgcatagataaacttatgcagaaactaatgcatacttaaatttgtatgcatgcacatatatacacacaaacacgtgcgtacataaactcaagcagaaacccatgcatacatacaactgcttgcatgcacatttatacacaaaaacacatgcacacataaacttatgcagaaacccatgaatacatacacctgcatgaatgcacatatatacacacaaatgcatgcatacataaaatcatacagaaactcgtgcatacatatgcctgcatgaatgtacacccatgcactcatacatgggaacacatgtgcatatacaaacacacatacataatacactcatgcagaaatgcatgcatttgtgcatctacacatacaaacatgaacacacagaaatacatgtgcgtacacaagttcatacagaacatacgcatacagacacataaacatacagagtctcaaggggagtcacccaggtcagggccagatgggggacatagctgagactcaaagggtccatatgggtggcaatggagccctgatcaggccaaaaccccaggtacacaggctgcaggctccagccccagtgccagcagcatgcaggtggatgaagccagacaaggctcaagcagcagcacagctattcttctgctgagcctcccttaactcaaggccttctctccatggctaggatgtagtttgctccccacatttcacttccagacctcagcttgaagaagctcttggtgatgatggctgacggcaagacatgaagaacaggccatgcatttccccagaaggaaccatgaacctatggacacaccaagagggtctctgctttgcactgaatttactccaccccattcttccagcttagtgggagatttgcagcccttcagattagcgaacagatactaagtgtgcacattttgcagtttgcatgcctaaaagtgagttcagtaacctttgacacccaatccatcagggtggtccaggaaggacagttgtggtccaggaaggacagctaatgttaacagtgacaaacgatgaccgccaagggctctatcaaattgcatttgcaaatttggcttttatctcactaccataaccatgcaccactgtaaccatctgtgtcgattcagcactttttctattttaatttttattgagctctgactaggtgggaatactaaactagcccatatgcccacctggaaaagagcccagtgctggcaaaagagtaagcttatttgtaggactgcattctacatttcatccatgtgcaaaaaaaaaaaaaaaaaaaaaaaaactgaaaacataaaactcgagaaggaccacctgatacaggtgattattttcttttttttttctttttacttttgggaaatatttcaccaaaccatttattaggctaattaatggaagtggggagccctaccttcaacacacagaatactggctgttggatatgtccatctgttcaagtctcaatgtttctttcccttccccccaaatccatatgacaaagttctaactgccagtgtgggtgtatttggaataatgtctgttaaaagaaaaaccttagacaaattaaatttaacagaggttaattgagcaaagaatgattcccaaatcaggcagccccccaaaaccagaataggttcaatctctggctttgctgcatggtcaaagatttatggacagaaaaatgaaagtgaggtacagaaacagctggattggttacagcttggcatttaccttatttgaacacaatttgtaccattggccacctttgactggtcaaaacttggtggttggcacaggagtggattccagtccatttgcatgtttgcacatccagttaggttacagtgcactgtgtgcagagaagctttgaggttgaacttaaaatatgtgaggaggcagctttaggctaaacttaatttaacaagatgtaattaagattcaatgatattatggtttggatgtgtccccacctgaatctcatcttgaactgtagctcccataatccccacgtcatgggagggaccgagtaggaggtaattgaatcataaaggtgggtctttcccatgctgttcttgtggtagtgaataagtctcaccagatctgatggttttgtaaagaggcgttcccctgcgcatgctctcttggctgctgccatgtaagacaggactttgctcctccttggcttctgccatgattgtgaggcctccccagccatgtggaactgtgagtccattaaacttctttttctttataaattacccagtcttgggtatgtctttattagcagcctgagaacaaactaataccaatgtcataaggatggagacctgatccggtaggattagtgtccttataagaagacactctggggagttcactctctctctctctgtctcaatctctctctatatatatgtttctctccttccttccctccctccctccctcactctgtccatctcaccctctccaccatgtgaggaaccagcaaggaggcactgtctatgaacaaagaaccaagtcctcaccagacattgaatctgccatgccttggtcttggacatccagcattcagaattgtgagcaataaacatctgtggtctaagcccccaaggctatcacactttgttgagcatcctgagctaagagaccatctctgggtgtctaacccctcacttatctattgctaggtcaaatggatcatacaatctgcaatatggttgagtgataggcctccaaaggaagcaactggacatcggccagctgaagaggtcagccagaggatcctactatggtcgttaaggtacagctcccacttcccatcaccaggacccagaggaagcacatgggtacatgtgtaggcagcgttttaattcttcagcatttatttttgccaagatggcagaagggacacgggaaacaatttgttcctcactgatttcttctgcataggctctgggttgagtaatgctccctgagtgtgtacacctgtgtgggcccagccagccctgctactggtggcagtgtggcctcgtaggggaagggctcgtgctttgctgacagggtggggaactttctggtaaaatgctcctggaattgacatttgacagattaactgtgctggaagacagagtcataaacagagggttctggggaaccactgagagccagaacctcatggtggacatctgtcatttatctatgtatcatctatttatctatctatctatctatctatctatctatctatctatctatctatcatctatcacccacccatctatccatctatatctatctattcatctatctatccatcatctgtctatccatcatctatttctctatgtatttatcatctgtcacctatctatccacgtctctatcatctatcacccatctatttatctatccattatctatctatcatctatctatctatataaaatctattacctatctatctattcatctatcatctatctatttatctatccatcatctctctctctctaactattcctactatggaaatgtgcttcagtgtgtactcaatcagagcttccccatgcacagatttcatttgggttcagcactctgaggggtacattgtgagtgatttcaaaggattcgaggtcaatcctggatattcccaggtataaggaaaggaatgtggaaactcaagctcttatccctgctttgtttaggccagacgctaaatagccaattacacagaggtgtgtcttgggctctctttgaaactccaggaacagtcgtgtaggctcacattctctttgccatctggccatttgtatgaatccagttgatgataacgcagcacatctaataagcaggtacctccataaatttcctaccattgatgctactgcatgggctgaaatatgtcattcaggagcaagagtgaggcaaacaatggccttcccagtgcgtgcaggaaataagagcttcctgtcaaggaagagacgagtctgttatttagcttaagcagatttccatgtatcagacaaacaactatatttaaaccaatgcatttggggaaaaatatatactggaatatatagttcagcattgcaaagaagcaatgcctgaattgttgtgagttttggtatacgtccaccaaatatcctctccctaacaatggtgggaaggaaccacacctttagaactctctgggacccaggccacaggaacgacatctaaataaaattgctttatactcctctgattggggagagtagaaattatgctttttgctctctgggaaattgctaggtatgcttgcgattcaggaaagttcttacctcactcatagttaggttgaagcagaggtgtcggaaagacaagaggagtgaatgtgatttgaggcttttaagaatcagtatctgacctttctcctaatagaaagtttttcttccatgtgcactttcttcctccactggagactttgcttgcaagcgccttgtctgacatttgaggacccttatcttgattgagttcatgtagagctcttggggttgggatggggagcttagactccccttgggtagggccctctcggcttccctgagaaaatatctcagccagacattcgctctggatagacttccacatttttctctattgtgtaactttgggcaacttgagtaacctcagaatatgaggtaattacagcattttatttcctaattgacccaaatctaattgcatccaaaaagttgcaatgcccttggctacagcctgagatatttctgtaaaatcatgaaagttcacaagaaaaggattagtggaatttctctgagccaaaaagcggaggaatctattgttatcctaagaagtccccaatgtagaggacacacatcaataacaagatatccttctgtgacctcagggaaatagtctccattcgtggcttggccaacatcgtggcatcaatgtcatctcatttagcttgacttttcttacacttggatagttgcttctattcatctttcaccccattttctgctttcatgtctgtgcaggcatgaattcatagcttccaatcttataactttctcattgtcttcaccagattccctattatttcccttttcctggtagtcttggtaacagctggagttacccatactcaaaaatcataatttaaaaagtcttcatgaatgaggagggcagaaccaagaaggatatctggcctaccacctttgcagaattctgtccaaaagaatgactcaatattgtaccttaaaactatctcctatttccaagcagacaagatcattgtgctctctctcccacagtgtcaaagaattcatgctctctttctttccttcttcacacatttccattctcactatactcggcccacacctagcacattgactggtatacaccaggcactcaaacagtgtctttgcttcatgaatgaacgcattttacctttacccaatgatatcataactgataagagtcctcggttggattttttttaatgtatttatggagtacttcaaaatttcctacagagctatagtaaccaaaacagcaaggtaccgatataaaaccagacacacagaccaatggaacagactagagcacccagaaataaatccacagatctaaagcgaactcatttttcacaaaggtgccacaaacatactttgaggaaaagacaatctcttcaataaatggtgctgggaaaactggatatccacatatggaagaataaaactagacccctgtctcttaccatatacaacaatcaaaataaaatggattaaggacttacttttttttttctttttcatatctgttttatttcagccctctaagaaagttaattttctaacacttccctttgacaagttatcttcttcactcccttggttgtcattgtgtaccattttctcttccactaaatattcacagccattttcctcctttgtggggggccagtcctagtgatatttcccagcctgatctttttttttttctgtttattcagcatcttttttggttaatggaaacagcttaggaacatttataaatgtggttcgacattccaatctgtttccataatcctttttgacttctctcaagtaagcaagtgatggctaagtgtttccaggcctgcggacattttcctgaggatatcctgagggaaatgtggaatcttcttgggcttttcctgaaattcagctcatgagctcccaagaatgcctgctgcaaccatgcacatggagtctcctcatctgaaaataacattagacacactcagactgaattgcctgctcatggaaatgtttcatcttcatctttggcaggaaaccaggtgattcacacaaagacaggtcctaattaatcactggcaagacccaatctctctagccaattatatgacttgccaattattttgctttaaagccttataaatcaaataaatgtgcttcttccctccttctcccagttcctgttttttcctgccttcctgtaacctcttcccttcttagggaagccactttcttatctattatataattctgtggaagaaaaatctctttcaattagcgtttgaacatgtcttccatgcacatacctgcacacatgttgccattggttaaatgttgtggaactatcagaatgatgtctgtaaactacagactatcctaatcttgttggatatttgagtgtgtttataggtgtactagcaaattttaatgagccctgatagcatcaatatgaacacgttgccagaattattctaacacgtgtgaactaacatgttcacgcttctactgcttctaacaggcataaccttaaacccatgaatttctatttttaaaggagtctgtggatgtttcctgtatcacatgacagaaacatagatgctgtatcatagcatctggtaagcattgacggtaagccatgtcacgtccttagttgcagctgctcctcgaacaggaattggcttctctccaaatattccgtgaggagaatatgctggtactgctttgacactgaagacgtctcactgaaaaaaaaaaaaaaaagtatatatatatttaaggttttgccaaggaaacaaaatattcagggaaaaaaatgattgcttgaagtccataagatcatttctgcctttcatacaaaggtctgtgttttctgtggacatccagaatcgcagctaatgtcatagagagatgcctctcccatttccaaagtgctgcggagatatgcttgcaaaagatgcagcagtccagggagggcatgttgttcttctgaatagtcttctatctattttctaagacacctctagaggacattgggaaatgtctggaaactttttggctatcacaactgggtggtcctactggcatctagtgggtggaggcccgggatggtgttcaacaacctacagtgaacaaaacggccccaccacagagaatcatccagccccaaatttcaatagggctgaggctgagaaacactgcctgaccatgagattcttcatctatctatctatctatctatctatctatctatctatctatccatttttctgtcatctatcacacctaacatctatccatatctatctgtcagctatcacatctatctatctatctatctatctatctatctatctatctatctatctatcatctatcacatctatgtaactaccatctatatttatcatatctatcagctatcatatttatctgtcatctatcatctgtcatgtctatcatctacatatctattatctatcatatatatcacctatttgtctgtcatctatcatatatatcatctaacatatttatctatctataatctatcatatctatcatctatttatctgtcatctatgtgtcatctatcatatttatctatcatctatcatatctatcatctatcaatctatcatctatctgtgtatctatcatctattcatacatcacctctatctacctatccatctatctatccatcatctatgtatctgtctacccatctatcatccatccatctatcatttacatctatcaatctatctataatctatatttccatgtatctatttctgtctgtttgtcgtctatatacctatccatctattatctatccactatctatcatcattattatttatctatctatcatccatctatcaatcatctatctgtctggcatctatatctatttatcaattatctatatctatctatctatctatcatctatctatatctatctggctatctctgccatttatctatctatgacagtggatttcaaatggggggagttttctccccagggcacatggggtaatatctgaggacatattcacttgtctcagtgagtgaaggggtgctcctggcatctagtgggtggatcccagggacgttggtcaacaccctacagtgcataggacagccccaccacagaatcatctggtcccaaatgtcttgtttctcttgttgagaaaccttagtctaaagcaaatatttttcagtcaagatttttaaaattacagtgggaatatatacatttaaaagagtttctaaaaaggcaagttagttgggagtaacatttctcagacgtatgttaaaatcattaatccataatttagtttttagagtttgctcttgacttctgtttctatctggtttgaaaaatagaggtcaattaacttatttcaagggtatggaaggttttaatccccattgtttttgaagttcactgaaggaatatttattctccagctgaataaataacatctaaagtggatctgacatttcaagtctgtttctgccttggaagccacattgcccttagcttggggctcaagaaaggtgtgggtcctactgaatccttctgagtttgctgtttataatataacaaagactggggaaaaaagccccacaagttctgttttcctatgatgtagaaaacaataatcccagatatttttaaagccaagtgttgaactgaagaacatcatggctaattttatattaggggttgtaaaacaatgggccagattgggttagaaggcatactagcatggtctaaaaatgacagagggatagtcaaggttgagtgctgtgtgcacccaccttgcattgcatccttttgtcctctaaccccacttcctcaagctgtccactagggtccatttctcttctgatacctttctgtcagcacagaagctggtgctggaagaactctaacctccaattcagaaagccaggttcagtctcagtttttcaattagcaataattgttttgttttggttttttttcttcagaaaacatgtattattgctcctccaggggccagacagactcttagatggctccagtaatgctcatgtcctgatatttatgctattacataatcgcctctccttgagtgtccgtggggtccatggcttgcttctaatcaatccgatatgacaaaggcaatgggatgtcccctctgtgattacactacaggagattgtgagtttcatcttcctagcagcctctctgtgttgactctttcccttgctgggtacggtaaacaagctgccatgttgtgagctgccctatgaagaagtcaacataatgaggaattaaaggcagtctctaggaatggagattctcggtccaaaaacctatgagaatctgaatcttgccaacaaccacatgaattaccttgaaagtagattttgccccatttcagccttcagatgaaaccccagccccaggacataccccatttgaattgtaccaattttaccaactcaaagacactgtgagttaaaagacatatgttttataagcttctaagtaggtgataatttgttagacagcaatagctaacttatacttcataagtcaacattctatgagagcctgagactgaaataggcactgtcccttctctcaacacattcagatattagaagtggggtttgcagactggcagtgtgaatgatcttgagcaagtttatgaatttctctgtgatttcatatcctcagctttccaagaaggatgccaccaggtttacagagataaagtataataaaagtgcttcagaaaatgtaaaactcaccacaaaggaaaagtttgaaattgtttcagtggttctctcttaccactgtgaaataaaaatctgtattgatgacttctcaactggttcaaattttttaatctgtttatttcttgaaaatcatacaatcttgccttcaaaatggtaaagattaattagaaaggaaaaatagctaagggtggaaaaggccacacataaagttgcttttttattttctattgattataaataaaactaggggattcttatccttgagcatgatagaactatagtgctatattttgttggtggcaggatatatacagttgtctctaggtatccatgaaggactggttccaggacctcctgtagatacccaaatccacagatgttcaagttccttacataaaatgatgtagtatttgcatataatctatgcacatcctcccatatactttgaattgtctctaaattacttaaaatactgaaaacagtgaacatgctacacaaatagtgattatactgtattgtttggagaataatgacacaaaaaagcttgtacgtgttcaacgtggatgtgatattttttcaaatattttcaatgggcagttggttgaatccgtgggtatggaactcttggatataaatccaaatgtactctttccttttctttaaatataatgtatttctagtgcattgtgctcagtgaggttgcaattgaaggagtctgatattactatgatgaattgtattatgaaggaatttcctgagataaacatgtgaatggcagagtggcaggcttaatctagggaacctagaacacaatctattatgtatttcaggacataagcatctgtcataatgtttacacttgcaggatctgtttactatttgctttcagaagaattttatatttacgcttgcagtaaatctgtttactatttgctttcagaattgtggacttttctttttgcacatgcaccacagaaaaaccaagatgctccaatgctgtcagtaaaagcaagcccaggatagggagatgttgtcacttttaggagtgtgaactgaagacatccatattcacatctagttcggctcacttgtcatctgcatctctggcaccaagttcttttccctctgtgtgagtatcaacaaaatggagatagtagccaatagataatgtcttctgaataaatagatatgcacaatgtacttaggaagaagagtctcacatgttgtcagtcctgtgtaaatgtctttattgctaatattcttaatccgcagtttgtttaagaaaagacaccacaaagaattcaatttctctacttttgagagatgcaagaaaactctacaaaataaaagtgatagcttatttacttctctaattttttttacacctcctcagctttcaagtgagggatatatagttttgcatgtgaaagtggtttataagttataaattcctgttctattgtttgaatccatccccttaaattcgtgtgttggaagcttcatccccggtgcaatagtgttggaaagttgggcacaataggagataattaggtcttgagggctctgccttcataaatggattgtcattatggcggaagggagttagttatctccagagcggacttgttagctggttataaaacagtttggtgttttctctctctctctctctctctctctctctctctgtctctcactgtctctctctctctctctctctcccccccccccagcctgtgcctgttctctttttcttatgctttccaccatgggatggcatagcaagaatgccttcaccagacacaaccccctcacccttggacttcccagccttcagaactgtaggaaatgaatatctattctttccacattacctccatctcagatactctgtgatagcagtacaaaattgactaagacatcctagaaactggggagattgaagtcctgtctgtgtgatatctctgttgcatgagatcaattactgaagtcaagtacacccagtaagtctatgttggaaaaactcagtgatctgttcttacactgcatcttacttgagcaatctctaagtgaccgtggacacactggttggaggaccacccatcctggtatgcccataactgtcctggctttagtcttgtgtcctgggaaccccattagtcccaggcaaatggggatgatacgttaccccacacaatgggtccctccctcttttttggttttgtgttcatttgatttcaggacactgactcttcttgcttttctactaatacagtttacacaccttcagtcttatcttccaaatctcctcaatgtcatcctactcttgaagagtcccaggctcagcctgttcttttctatctttgctactccttaggggaactatgtaatctcatgtctttaaatattttcgttggccaacaaccctcaaatttatatcattaactttgattcctctgccaaactccagacttgcatatattcaaccacccacttcaacacctccacttaagtgcttagtggacacatcatttatatccttgttcatggacatctccaattcagcatgtcaagaactaaacccctggcctacctttgaaaatgtctcccttccacccttccccattctctggtcaaatacctggaatcaatattcactcttccctttcacatccatcaatgaagaaatgttattagttttactgtctctattagtttcgtagggatgtcataacacagagccaccaattgagtggcttaacacaacagaaatctattatcttgcagttttagaggccagatgtctgaaatcaaggttgtagcaggattatgctcacttcagaggctctgggggagaatccttgtggaggctgtaacggggaatctgttccatgcctctctcccagcttccagagcctgctggaaatccttggtatctgtctgttggcttatagatcatcacccaccctagtgtctgccttcaccttcacatggtactctctctaggtgcgcatttctctgtgtccaagtttcccacttttctaaggacatcagtcatattaaattaggtgctcaccgtgctccagtataacttagttatgtctacaacaactgtattcccaaataaagtcatatccttaggcacaggaggttgggaatttcatatataaatttggtgggagatgcaatttgacccataatactatcataaccattttaaattgtacaattcaccagcactttggtgcctgtacaacatgatgcacccatcaccattatctggtttcagaacattttgatcaccccaaagctatacctgttaagcagtcactccccatcctcctctccctgcaacccctgcatagcactaatctattttttgtctctatgtttaaaggtacattaaagcagggtatttctaagtaggttgtaggcaaacacatgagcaaatgaatgcctggttctatctagacagtttagatcccatatcgagtttgtaacgaagtcctctttgtgggttctgtctttacaaacagcctaggaaaacttaaacgacctcactcctggatcgttaagtatgttgactagtaacttggatgactggattttacagcaggctttgtaagctcacccaattaaaaccagctgaagaaagaccaatctagtcccttgaaaaaaatgagatttacatatctcataatgcaggtggggtgcaggcatagtaacataagaaaattctgctagatagaaaaactaagttgtagtgtccaatagtacactagagaaagtagaattaacaataacttatcgtatatttcaaaatagctggaaaagaagaatttgaatgctcccgacggaaagaaaagatagacgtgtgaggttctgggcatcccaatcattctgatttgatcattacacatcgtattcctgtatcaaaatatcccatgtacctctgaaataggtacaactatgatatatcaattttaaagaattaatttagaaaataaatttaaaacctaaaagaaaaaaaagactctgaagagtcccagggttgcaaagtcagggttttgtgctgagggagaaaagaatatatcagggcaaagctctggtaaaaatcaagaattacttaactgtgttctctgctcaccagacaataataatcaagaaataattatttatcatttgcaaatctccatcttgctcctttagtatgatgggagatttaataacaacagcgttgtttgcaacagcattcgtgtttgcatttagagccttggtaggatctcacacatgcaaataaactcaataatacatgtcacagaagagatgagctggccatttccaaagaaaaaccccaaaacttaacccatttatgcttgaggttacaatattttgaatttttgcaatcagaccttggcgatgacctgagcagtaggatataaataactccgacgtgctcagcgttccattggaacgctaggcataaatggctcaaagctatcacacatttcatcttcagctcagcatgtcccttacttcatggatatgcaggcaataaacagaaaattcagagttcctggaacaccaaactaaaatgggaacgtagcaaaggaatagttcctttttctctgacttcctgctgctttgttgctggggtttgcagtcagaaaactggttcttccttttcttccctgttggatttgacgatggaatcagatggactgccaaggtcaatatatattaatatgccaccatggaatgtactttatgtttcagtggatgttggtgcatttgacggtgtggtaatggaaattgcctttagagagcaattgctaggggccagggaaagaaaagttcagtgactccaacggcaagtaggattagaacaaattcctctgggctgtggcaataccttggctgcagggcatggggaagttgagcatctctatagcttctcagcaacagcaacacacagatcaagctaagagctaagttcctataattgaaagagtgaaattacgcagcacagtttctaaaatatgatagaaaaaaggggaaaacaaaatcctcttagatccctttaaagaagaatttcttgcaaaacagttttactcctcatgaaagaagcagtggaatcaatcagataggtattcctttttatgctttgctttgagaaatgccaaggtttttccattttattatagcaccctgtaaaattaaactcaatttctgcaaatggagtgtcactatttcatccacagattcatgaatataactgtaaatcatttagcatctgaagcattcttaaaaaccaccaactaatctataatttgggaatattaaccgatccctttctaaattaggtgaacggaatttcttttggtgaactctgatgaagcttctgagaaaaacttctggccacaagtttactacgtctgtacttcaccattgttttctttctctgtgatttttttgaagttcttcataaactgaagaacaagttggaagttcacatgaggtaaaataaatatggtggtcataattttctagcatccccaaacaagatatgtttcttatttacaagggttgtggctaaactggatttccctcaagagactaggcaacatcaactctataatgcattcacttttgttcctggctttatagtactattaaaatatttttattgtcatgaaaattgggccaccctggacaatggactttgactaacaaagaaaataacatcaaagcaatgtcattaaaataagtttctgtttgcctgacagctgccttttattaaagcaaagctaaaatgatggagctgtatgagtgtatcattggattactttatttttaaaggaaaacatgttataaattatgtcaactttcctcagagctaagaaaatggaagcacatcaggtagatcataatatgaggactattttagaaggaacgctcttttgcatgtttgtttgtttgtttttgcacaaactgaaagagcaaacatttcttcagagggctgggtgctttatgtccttatatttttttcatgggatcctcgcagcaaaccagtgtgttctctttcttgttcttggttttacaggtgagaaagctgaaattacacaggtaagtgtcaaaccccagagttgaatctaaatgtgtgccgctcagggtttgtctaaagtactttcctgcctgtggaaactacagtatcctttcatttaacttgattttcaaaacaaatgttacataagtatgcatgcccagaaacataaaaaaaactgaaaataagatgtcccctgctgacgtctaattcgattaatgatttttatagagtggatatattgctatctatccagcaagccatcttctagaacaacggaaagacaagatgagctaaatctcacaaaagtgtcaaatgcataaattctagggcttgctgactgggttaaagatttacactgggtggggttgcccaagacagagaagaattggggcggggttgtgggtgcataaatttctcttaagctactgcctgaatgggtattacttagaaacaaatcaatttgtctaatttcttccagacatttccttgaacaaacaatatacttcaatctccccccactgactcatcatcaggcagtttgtttatttgcctatttaactgggttttcccaaacaaaggagggaccttgctatgcaaagtcctcttcagaagtcgcatccattttagaagacatgtgaaataaaatggagagaaaacgaagggctgagaaatcctcaaagctgcatacatctggttttgatttgggtctgtatttttctttccctctggtagctttcgttttcaaagcggccagtgggtgaaacattttaattgatgcaaccctttttccaatgtcctggtggtcatccctgaaaccgtgtcgcatggttctctaaaaatgcatcgatgatagaaaccctctgtctcctactttgttcagacgcttgcaaaaatctttcttaattgatcccacgtgttgtagtgtggctaaggtatcaatatttcatagcactaagacggaacttggagtagtatcagttccccattcccccaaccccaggcttgacttagcatagcaagttctttagatttgcaaggagtgcccgaaaagtcaatcagtaaaaataaatacaagctttattcagtttatactgcatctgaaatattaatctttacaataattagacttaagtttttcctcttctcaagcacagagggaagctgtcttagttcatttcaggctgctgtaacagaataccacagtcagggcttataaacaacaggcgtttattgctcacagttctggaggctggaggtccaagaccaaggtgtggcagtttcagtgtctggtgagggcttcctggttcacagacggcaccttctcactgtgtcttcaaatggtggaaggggcgagggagctctctggggtgcattttatgagggcactgatcccattcgtgaggctccatgctcatgacctcatcacttccccatgcctcacctcctagtacctttggagttaatgtttcaaaataggaatttgaggagatatggacaagctgcaggtattcaagactattacattaatttaggaagataaatacaggaaggaatttaagtttagctgcaaatgcatgtgcccacacacacacacacacacacacacacacacacacaaatacaagttttctcatttttttcaaagctagctccccataggcagagatctgcagaagatggggctctggacttgataatgtgttctaattctcccaaatgttgctttatgaatttggatgctatgctactagctgaaaaaaagttcaacatttttataatcttattttataattttataaagttcagcattttataattatttttgacaaaattttttataacttaaccacaaccttctttacttttcttttcttttctttctttttttttttgagacagaatctcccactgttgcccatgctggaatgtagtggtgtgatcatggcttactgcagccttgacctcccaggctcaagagatcctcctgtctcagcctcacaagtaactgggactacaagtgtgtgccattatgcccagctaatttttttaaattatttgtagagatgaggtcttactatgttgcccaagctggtctgaaacccctgggcctttttcctttcttttctgcttcttgttaaccaaactacagaaatgttgtatttacttactatgttatttttttctccatacctttgatcttggcctttttctgtttgggccttcagacccttggaaacagcaaagacctggatttttttcaatctcatctgagagttcatgtctactaagatatattttcaggccatttatatttattacagttgataacagttttacaatgtatttcttgtcttcaattttatacattctattaaccattcattttctttgtttcgataatttctattttctgatacctaagtggggtttttttaaaagttttttttcttttttgagaaagctgttttcagtttgtattcttttacggactggcaataaatttaatatgcatagtaacattcacaggaaataaaataaagctaatatttatactctccttccaaacaaagaaataacttgttttagctctgaccattgcatttttctcctacaagctattgtgacctttaattttagttccaccttccttttagaccctcaatagagaatcacttgaacccgggaggtggaggttgcagtgagccgaaattgtgccactgcactccagcctgggtgacagagtgagactccatctgaaaaaataaaaaataaaataaaataaaaaacggaccctccatggaggtatccttttattattggtgctggatggtgatggtgttttatatggctgacactagttttgatttaactccggttcctctatttttctgatgaccagtaattttttttattacttaacttgtattttaagtacaggtgtacaagtgcaggtttgctatataggtgaacttctgtcatagggatttgttgtcacccaggtactaagcctggtagccattagttgtttttcctgatcctctccctcctcccactcttcacccaccaaaaggacctagtgtccgttgttcccctctatgtgtccatgaattctcatcatttagctcccacttgtaagtgagaacatgcagtattttgttttctgttcctgcattagtttgttaaggataatggcctccagctccattcatgatcccacaaaggacatgatctggttctgaattcagtctatcattgatgggcatttaggttgtgtattactccgttttcacattgctataaagaacttccctgagagtgggtaatttataaaggaaagaggtttaattgactcatagttccacatggctggggagacctcaggaaacttacaatcatggcggaaggcaaaggggaagcagggcaccttcttcacaaggcggcaggaaagagagagtgcagggaaaactaccacttttttttttttcttgagaaagtttttctcttgtgcccaggctggagtgcaatggtgcgatctcggctcactgcaacctccgcttcccgggttcaagcgattctcctgcctc[134 bp omitted]cgacctcccaaagtgctgggatgacaggcgtgagccactgcgcctggccggataactgccacttttaaaccatcagatcccataagaacttcttcactatcatgggaacagcatgggggaaaccgccgtcatgatccagttacctcctccagggctctctctctgcacgtgggaattatggggtttacagttcgaggtgagatttgggtggggacacagggccaagctacatcaggttgattccatggatgccccgtatttcctgcatcttctgccttcctccagctttggtacctctctccctatagagcatctttgagtagttccaacagtgagtcgaagtaagtggaaaacactctggctccaaagtggtgcatttatttcctgcttactccggaagagccgagctcagtgtagagctgtccgcagtcaggaattccccttgagggctctgaagaccttttcccattgttcccagggccctcccaaccctgctggggtgtcttctccaggtcatgcagggtgtctgggggccacctgtctggctatttaaaggatttttctttgttttgggggctcccatatttttcctgagtattgtgtattggcttttacttatactcttttactggaagaaagaaattctgtggaggagctgagaaaataatcaaccattgtttgtttaaatatggctgagccctgtcctctccaaacagcccttaggggcattgagtaaaagttttggcgacaccacctcctttgttctgcggctttgaaactcattttcaatttgccatgtcagaacttcttggagcttggaattatctcctggcctctgaattgcttttttggttcaagtaatcctttgggttatttggttatttcaacaaatatgtgtgtgtgtacacaaaaatatatacacacagacacacacgtgtatttgtaaatatacatgtgcataagtgtatatatactcatatgtttatatgatcatttaaatatatatatatgtttacaaacatataggtatgtgtacatatctacacgtgtatttctaagtatatatgtatatatgtgtatatgtacatatgtatatatatacttgtatgatatgcttatataagtatatatacatatatttacaaatacatgtatttgtacatttagacatatcagtatttgtaaatatatgtgtatatatacttacatgatctatatatttagaaatacatatgtatgtttacatatatacatatatgtgtatttgtaagcatgtgtacatatgttaatacttatgtttatatgcttatgtaaatatatatgcctgcatatttacaaatatgtatgtatatgcattatacaaatatgtgtatttgtcagtatgtatgtacatatgtgtttatactgatatataagtatacatacatataatttataaatacatatgtgtatatacatatatacctatatatttacaaatacacttgattattttaaaaatcccactgttctttattatttattatttcaattaacaaatttaaaagatacatatttatgggatacaacatgatgttttgatatatgtacacactgtggaacggctacatcaagccaagaaatacattcatcacctttcatacttatcattcaagggaagggtggaaatctttaaagggtgttcctgtagcaatttccaaatgtaccatgcatcgttattaactagcatccccatgttgtataacagatctcctgaacgtattcttcctataactgaaatgttgtgttctttgcatatctccccttttcaatattttttccccagaggactttgtctctgttttcattgtgaactcagcatcttttcatgtttcaattccttccagattaggggtttcaccttctgctgcagactgctgcccaatcagctgacgttctctggggacacacctgccctttgctgaggctgtggatgggaactcattgtgagatttttttgccatgtgtggatgggctctgcaaggttgcaagaaacaaagtcaaaaaatgggtacaaggctcacatgtttttcacgtttgaaaaagcaagtttcaattttttaaattttcatattgatgtataatgattaagtcagagtatttggggtatccatcacctggagtattttttatttctttttttttttttttttttttttgagacagggtctcactttgttgcacaagctggagtgcagtggttcaatcacagctcactgcagcctctacctcctgggctcaagtgatcctcttgcctcagcctcctgagtagctggaactgcagatgtgcaccaccacacccagctaattttaaaaagaattttttgtaaagatgagggtcttgctctgttgctcaggctggtcttgaattcctgggttcaagggatcttcccatgtcagcctcccaaatggctgggattacaggtgtgggccactgggcccagccctgtgttggtaacatatcatctccccttccagctactttgaaatatacaatatattattgctaaatacagtcaccccactctgcaagacagatgcctcttgtttttactcatatgtggtaactttaaaaattgacctcatgatgggaggatcacttaagccttggggaggtcgaggttgcag[132 bp omitted]gggtgtgtgggtgggaggcagaataaagaaaggttggtgagtataagccccagtgtttgataaaataatttttttagaattatcccaattccaggaatttgtggaaagggggcaaaatcctcaccattctaccagtgcttggatgtccgcctgggctgaaccatgagagaccaagctcaggcactttggttgagcttggccagggggatacctcgtccctggaatttgcagacatgaccccagttgtgttccagcagactgcccagatatctgcagaccttactgctccagatcctgacttctttccagttccgctctgggccagacctgttgcaaatatgcaggatggaccctaagaaaatgtcactaaactgagaggcgatccttcaaatacaaagcaacctctccagtaggaatgctgtgctgaattcatgaacatctctaagttcttagagcatcagaaaatctgcactaaaattcatctgtcctcctcaggaatggcagtgaagggctaatgctttcatttgacttctccagaactgagctgagcaattgcatggtccaggctgtgacaactgtcacatggagaatggtggcagcccaagggatacatagagaaactaaatgtggagtggagatattcttgaagacagagccagccctaatacacatatcccagacatgagcaattcacaccacagcaagggctccagcatgaatgtggctttagaatgaatccgtgggcacgtggttggtgccagcccctttgtttggtgccatcacatccatgcttctcaggcacattctgtgtttgctgctgctgcagatcccactcaccaaacagatccacattcaaatgaacatatgaggtccccacgccctccaccccatcaagactgaagctcttactccaaagacattgaacacccctggtcccaggtaatttccgctgctgcatcttgcacaacccaaagaggtgtaagccaagacttgattgtggaacctaagagggaagacaagctcttcatgataacctgcctaccaccaccagctctaggtccacagggctgatgccccataagggaatggagctcatgaatgtgtattgtaccttccgggtgttttgctgccttgcacgtcaagctctgcagccttccagatccccttgttctctgactgagaaagggaaaaggaagcgattgaacattcctgcagtgatattactacagtctgaatgtctgtgtcctctcccaaatgcacatgttgcaattgaatcctgtgatggttaatagtgagtgtcaacttgattggattgaaggatgcaaagtattgttctgggtatggctgtgagtcagtggactgagagaggcagacctaccatcaatctgggtgggcacaatttaatcagaccaccagtacagccagaataaaagtaggcagaggaatgtggaaagactaggctggctgagtcttctggctgccatctttctcttgtgctgggtgcttcctgccctcaaacatcagactccaagttcttcagcttttggactcttggacttaacaccagtggtttgccaggcgctttcaggccttcggcaacagactgaaggctgcaccattggctaccctacttttgggggtttgggacttgaactggcttttttgctcctcagcttgcagataaccttttgtgggacttcaccttgtgatcaggtaagtcaacactttttaataaactccctttcatagacacatctatcctattagtcttgtccctctagagaaccctgactaatacaaatctgcaatgtgatagtatggaaaggtgaagcctatgagaaggggttaaatcatgaggcctccagccttatgaatgggattagcgcccttataaaagagactgccttccacagtgtaaagatgcagcaagaaagcacaatcttggaagcagagagtgacactaaatctgccatgccttgaccttggacttccagcctccagagctgtgagcaataaatgcctgttgtttgtaagccacccaggctgtattagtctgctgtcatgctgctaataaagacatatccaaacctaggtaatttatgaaggaaagaggtttaattgacttatagctccacatggctggggaggcctcacaatcatgatgaaagagcaagggacatcttacatggctgcagacaagaagtaagcttgagcagggaaactcctccttatataagcatcagatattgtaagacttattcactaccatgagaacagcacaggaaagacccacccccatgattcaattacctcctgccccaccgggtctttcccatgacacatgggaattgtgggagctccaattcaagatgagaattgggtggggacacagccaaagcatattataggctaaggcattttgttatagcagccagaacagactaagacagatatcaaacccaaagtcaatgccatcccctataagcacaagtgttggagcaatctcttgcaaacatttatctgagctcagctggctctgagaagtgggattttttgcctcattcattgggtcctaaagcctgtcatcaagcatggcagtgtatgtggttatattagaaggacaacatggtagatcttgtggtgatggaaatgttctgttccttgaccgtaccaaggtcaatatcctggtgtgagattgtactgtagttttatcagaggccttcaaaccagagtgactttatcttgaataggggctgggtaacatgaggctgagacctgctgggctgcattcccaggaggttaggctttattagtcacaggatgagataggaggtcggcacaagatacaggtcataaagaccttgctgataaaacaggttgcggtaaagaagccggccaaacacaccaaaaccaagatgacgacaagagtgacctctgatcgtcctcattgctcattatacggaattgcccacccctttcccagaaaactcatggataatccaccccttgctttgcctataatcaggaaataaccataaaaatagccaaccagcagcccttagggctgctctgcctgtgaaatacccattcttttatgctttcactttcttaataaacttgctctaactttatggattcgccttgaattctttcttgcacaagatccaagaaccctctcttgggggcctggattgagacccctttttggtaacagttttgcaagatattacccctgggggaaaagtaaagagtaccagggatctccctgtgttatttcttttcttttctttttcttttttcttttttttgagagaaggtctcactctcttgcccagactggagtgcaatggtgcaatctcggctcaccgcaacctctgcctcccaggctcaagtgattctcctgcctcagcctcccgagtagctgggattacaggagcgcaccactaccgcccggctaatttttgtattttcagtagagacagggtttcaccatgttgtccaggctggtctcaaactcttgacttcaaataatccacctgccttggcctcccaaatccctgtgttatttcttacaactatgtgtaaacctaaaactatctcaaatttaaaaggttaattttttaaagttcttaaaagtttcgaagattaaagaaatgtatggatcagttcactgcatcttggtctcaatatacacaaagatattcgacatttttttcctctataaatgctggctttcaagccaactatcttgaaagggattcaaacaaaaacataataataattcgagagtcaaagcagaggaatattgcttttttctaagggagtgtccacccatctcttgaagctctggaattctttgcctccatgcattctaaggcccgagagaaagagcattcatagggtatgaaaaagcatctgaatatatttctatataaactgcttctcatcacaaatatgtgtgatgcaacatccctgtggtcaaacacttctcagtcttcgtggagtagagaacgcacaactaattaagctgggaatcacaaaacaatgtgatctgagcaatgctgaagttatatcctggagattttatagagttcttttaggaattatctcacattggcctttgatcaacagaaaggagagagatggctgagaaattgcctatggaatgcaatttaggatgagtatgatcttgcatggggattcaagacatcaaggcccaagtgttttggtctaaagtattccatgcattaaaggtgaatgtgtcgtcatcatcaaaatgttgaatcccttgggcagatggtgcagatgaggagcaattggtggccctctctctctgctgttgagcatcctttagtaattaacttgataggggccatgttactcaatccttgtcaaggatgttaactctggaataatgtacaggctttgcaagtgttctcttcaatgctagaggatttagcatatccaatgcatttgttctagaaaatgattctttttatgcacacgtgtatgtttggtttggctttgttcgagtcagctatgcctctttgtccttccagtagagtagaaattattctggaaaaccaatttgctagttcttaaatattttcagaatcttccatcttcccttgaaagtgatgtatatgtcacttcactcatgaaatgctccccttaaagaatggattctggacattctgaggccaggggttctcctttcaaggaggatgtttacaaaacatttaatgccaattcaacctccatgaccacagatttttaatagagctgggttaagtgtgttttctcgtggaatcatgcatctgagggaattgggagcagagaaacatgcaactggagaatcattaactcagtgacaactggagcatatttttaagtagtggaaaattacataacactacatttctcaaaaatgggtcaacaaaaactgtcaaactctgcaaaattatttgaagagatttactttgagccaaatatgcatgaccatgacccataacacagctttcaggagatcctgagaacatgtgcccaaggtgatcaggacacagcttggttttatacattttagggagacatgagactttggtcaaatacatttaaggttgtacccagaaaggcaagacaacttgaagtgggctaggagtcaggggactttcatgttataggtacatttaaaatttttctgattggcagttggttgagtttatctaaagacctgggatcaatagaaaggaaatatctagattaagataggggatgtgagactgaagtttattatgcagatgaaccccccaggtagcaggcttcagagagaatagattgtaaatgtttcttatcagaagtaaggcctgttttgatgttaatgctggaggtctatactgagacatgtctaacccccacttcccatcatggcttgaaccagtctttcaggttaaattttattttattttattttactttgtttattttgagacgttgtctcgctctgttgcccaggctggagtgcagtggaatgatcttggctcactgcaacctccgccttccagattcaagcaattctcctgcctcagcttcctgagtagctgggactacaggcatgtgccaccgcacctggctaatttttgtatttttagtaaagatgggatttcactatgttggccaggctggtcttgaactcctgacctcaagtgatccatctgcgtcagccccccaaagtgctgggattacaggtgtgagccaccacgcccagcctgggttaaattttaaagtgccctggaggacgaagtccattcaggtatttgaggagtcttataattttatttttggcttacaatggcacattaatgttttagcaatgacaggaattgaaattaagagaagggagagattgaagggtggcaccaagattgaaaggagaaagaggttgagggatagtgagagaggttggagaagagagtaaaaagaggccgcttaagatgttccttgggctgcttggtctgaggacccaaggtcataggtggatctcttcacagagtgagggtgaggacaggggactggtctcccgaaggagtcccgctgacccgggtcttcggcaccaaatgtctcacgtgtccgtgtgaagagaccaccaaacaggctttgtgtgagcaacatggctgtttatttcacctgggtgcaggcgggctgagtccgaaaaaggagttggcaaagggtggtgggattatcattagttcttataggttttgggataggcagtggagtttggagcaatgttttgcaggcagggggtggatctcacaaagtacattctcaagggtggggagaattataaagaaccttcttaagggtgggggagattacaaagtacattgatcagttagggtggggcagaaacaaattacaatggtggaatgtcatcagttaaggctattttcacttcttttgtggatcttcagttgcttcaggccatctggatgtatacgtgcaggtcactggggttatgatggcttagcttgggctcagaggcctgacagttttattgtttcctctatactcctattcccccaaatcccataacgtatcaccttgcattattgatcaacaagatcaatctcaatcaatgagcaagattggctattatgtaacaatggcagcaaataattgtgttcaaatgtgggtttgtatgtagaaaaattggtagggctagagatttaggtttacaagttatcctgttagaagtgatattgaagtcattttggaagaaaacattgtgaagtaagcccatttagggaagatggaaaaaaggtgattaaagtcaggaatgcttttatgagcaataagtactaaaagcaaattaggaaaacagggtattaagaagcattccatggcatgattgctagtaaaatagagaagagtgaacttctgggtgtaactctattgataaatactatagaaacaaaaagggtcttgaagaaagaccagccagatgtggtggcttatgcctgtaatcccagcactttgggaggctgaggcaggaggatcatttgagtttaggagttcaagaccagcctgggcaacatagcaagactgccatctctacaataaattttaaaaaaaaaaatagccaggtatggtggtgcacacctgtagtcccagctactcggggggtggggctgagatgggaggatcactttagcccagaaggttgaggatgcagtgagccctgatcatgccactgcaccccagcctgggtgatagaaggagaccttgtctcaaaagggaaaaaaaaagaaagaaaagaaagatcaagtaaaaactcataggaacagatgatgaaatcatagaatggaaatggaaggtttaaagagaatgacacctcagctttctgaaactgcctttgcaaaaattatatcagtgaaaaaaattacggcagtgggggagatctgatctagccaacccgcctcatgcctttagcctccaacctgcaagacatttagcttatagtttaagtgataataggacttccgcaaaactcaaccgcctctgtaaagctaatgagagaccaccaggctaggccagagaagtctgaattctgctaaagtgcagacataaatggttggcagccattattccagaggtcacaagctatgcaacttccccaattactcctgcagataacatcaccattgcagaaccaaaggactggacttttgagatgtcttttcaggtgtttttgcatgtctgacacccatggcaacacctgaacccaccaactgagggctccacactcctgtagccccacccaggagcaactcagcccgggaggacagcttcagctccctatgatttcatctctgacacaaccaatcagcagcaggcacctattgcctagccacccagactccttccccaaactacctttaaaaaaccctagcctccaatttttcagtaataactttgtctcccatgtggcatggttaactttgtgtctattaagctcttgctttatttcaatgtcatggtctcggcaaattggttttgtctgtgcagggggtcagaaagaacccatcatgcagttacatctccacttgacaaatatttatttccctgagtcctcattgagtcctgaggctgagattgtgatgtattagaagccacgctctgtttaacacccttacacatataatccagccatcccacttctgggtacagatccaaaataattgaaatgagtgtgttgaagagatatctgcactctcatgttcactgaagcattatttacaataggtgagatgtggacaccacgccaatgtccatgtgcagatgaatggataaagaaaatgtgcttgtccagccctggtggctcatgcctgtaatcccagaactttcagaggccagggcaggaggatcacctgaggccaggtgttcgagagcagcctgggcaacacagctagaccccatctcttaaaaaaaagtttttaaatgagttgggcatcatggcatgtgcttgtagtccccagttactcaggaggcaaaagtgggagtatattgcttgagcccaggaattcaacactgcagtgagttatgatcatgccacggcactccagcctgggcaacagagcaagaccttgtctctaaaaaatgaagaagatgaggaagaaggaagaataagaaggaggaggaggagaaggagaagaagaagaggaggaggaggagaagaaggaggaggaaaaggaagatgaggaggagggaagaaagaagaaggaggaggaggaggaggaaagtagaaaatcgaatgacctacataaaatttggaagtgcaatgctttttggtaaccaaatatctaccaaggccaagccgattctcactattctactttgagggtacgtcatcttggaaaacttatagaactttgattagtctcagcttcttcatccaaaactcaaagccctaatttatcttctataaaatgagcaaaacgagggaaactgtcacagttggaagaggcaagagttgagaccatgcagtagagattcttcagtccaggtgagcatcaatcactcccatggtcacttaaggacgccaccaatacacagccatttccaccctagtgagcttctctaatgctacactgcacagcatccaccatgctccttccaattcaagacacagcttccaaccccactacatggctgtcttcctgcaccttgtcactccattttccttctcttcttttttctttccaacttttattttaggctcagaatgtccacgtgcacgtttgttacatgggtaaattgcatgtcgagggggtttggtgtacagattatttcatcatccaggtaggaagcatagtacccagtaggtagtttttcaatcctctccctccttcccgcatgcaccctcaagtagcccccagtgtctgtcattcccaactttatgtccatgagtacccaaggtttagctcctacttagaagtgaaaacaagcagtacttggtttagtgttcctacattgattcactcaggataacggcctctagctgcatccatgttgccgcaaagcacatgatttcattctttttcatggctgcatagtattccagggtgtctatgtaccacattttctgtatccagtccaccactgatgggcatctaggttgattccatgtttttgccattgtgaatagtgtcactccgttttccaccctcaaatatgactatgaatttatgctattgtgcccctcccattccactataatgttttttttttctttccattgctcacctagagcaaaatcattttccctctctcctccacggccccatcttcccatggtctttcagcacaccgtttccatccacagtgaggtcaggaggaggtagttaccatgactccttgctgatgtttatgcctctgcttttgtaataaagcacatcattggaagtccatgtcttccaatcatgccacattctacagttcttgtttgcctcacaaacaactgctcgctgtcagactcctggagcttcaatcaacccgtaaagtgaagggggctgctctgctgtggccctttctctatggcaaagagctctgagctctgagctgaaaacatctggagttgcatatttgactgggagagcctattgcaaagtgacaacattgcagtgaaaggaaaacagggacatcacacctcatttctcatgtggatggaaatctggactctcgtagaagctgaagagtggaatactcttggctagctcctagagcctagcttttacctcagaccaaagatccacagcaaaacgttctgtttgctttctattccttgctttgacagatttccagaaggagctttttcattgagtaaatgcggacaataaatttctcatcaaaggcaaaatgggttttgtgactattacccgtgttttctctagtttgcatcaaataaaccaggtttccgatggccattaattttcccagaatagagacactcatatagttgctggttatagtgaaaaggaaaaaaaagccccattattcaggatttttacagtcaaatctctgttcattttaccactaacggtacgccataatctcagtgtatggtagtattattttcactatactggaaagtggaaaattacagtgagaaaactgtgttctgcagacataagaggattgctcactcaatttcatgtgagttgctttctaataacattgtaggaggctattttgcttctgatctattctattctcttatgccatgctcttctaagcacctaaatttccgaactggagtttatgtttaggaaaatctcttgtaatggaaagaataaaactctactaccaaaagctaaggagttcaattatatattcttgtagtatcagcaataatgacatcatccctttgtatttactgggcagtgatacatcttaacaatctaagtaaaactaacaaagtcaatctaagaaaatctaacgaagtaaaaactggatttagggtagtaaacataagaaagacctgaggatcatacaaaactatccctttgatcttccttctccatctttccccacaggaatggccagaattgcaaatgagaataagagctatgcctccttcctccctcaacagtaaaatgacgcagaataaatttaacatggaagaaaaatggagataaatgcatgacctgggatattttccagtggagccacaagaagtctttcaaaccagtgacaatggaataaatacagtgcagcctatgcattagagtaaattgaaacttttcaattaggagaatagaaagtttgccttgcgggtcagagctttaaatctctttgtgttatgctgtgttttccatttttgtaccatctataatattttgattatttggatatagaggaaaatgtaacctcttttcttagcaagaaatagcatatagcatcatacaactcactaaacaaataaatcaacctgtttattgcttaaaaatgtatcacacaaattcagtttctgctttgttattgtaaggctgttgaatggataaataaagcatggttgtatgttaaaaaaaaaaaacagagagggagttggaagaagtccaaccacaatttcttgtgcaaaatcttacagaagctgggttgaagtgctttgtaccacttcattagtatttgttgtagacactgtgatgccaggccgtggagaaaccgatgatctgacaattgtaaatcactcaaatatgtacgtccatagagcaacatggattttaagaggttgtctatatttctaggaggaaatttactaacacattcacccaaatatttaacttagtatgatacgtcatttactgtgcaaatgcctgattgaaacagtatgggggaaagctgtttttatggagaaataaggaataaggaattcactgttcggtttttgtgtttggcctgaatgtaacagccttcactctcctctaccagaacgtctgctggcaaaaacacaatggcagcactactgagaacaagacctagacttaacctcacagttggagttaaggcggcttttccaactgtaacttcaatttctgcaaagcaatcattgatctgaacttcttctgtgatggacatttctaaatgatataaaggtggaaaaaaaatagaaaacttataggataatcctcattaattaaagtggtagttattatttgcttttcaatatgtaaaattttcccagaacaattttttttttttttagtagagatagaggggtttcactttgttgtccaggatggtctcgaactcctagactcaagcaatcctcctgctttggctttccaaagtgctgggattacaggggtaagacaccacgcctggtcccaaaacaattacatcattatgttcgactagcctgaaagatctcctcataatctaatgtcatctaaattatgaaattgattgggaatttgaatctgaattttggaatatacacaaggcacttgagttcctaaaaacaggaaatgtattctgattatcctaataataaaatgcccctgagaagtagcaggcatttaatattttgaagcaccattgactctgaatcccaaagtaatgtaatatttagaaaaccagatttttttttttttgagagtctcactgtgtcactcaggctggagtgcagtggcacaatcatggctcactgcagccttgacctcctgggatcaagtgatcctcccacctcagcctcacaagtagctgggactacaggtgcgtgtcaccatggccagctaattcttttttcttttttttttttttaagatatggggtcttgctatgttgcccatgctggtctggaactcctgggctcaagcctttctcccatgttggcctcccaaaatgttgggattataggcatgagccatcaagcctggccagaaactctgatttttaataaaaggcaagaggattgtgtgcagaatttgaaaatatatcttcttgatcaaaacgtgaaatcttgcatagatatgagagttccgatgaataagaatttggggaattcacacataaaaaatgcattcttgtcctgggcacaccggaaaaccacacacaatttagacccaccacccctggccccaaacctgcagtcaggaccaagttgtcaggacctaattaatgccaatggagtttggctacaagaccttcctcattaaaaataaatcacttttgatatgctaattaccctaatttggtcactgtgcattatatgtattgaatcatcactatgtaccccatgaatgtgtgctgttgttatttgtcaattttttgttcgttttttagacagggtcttgctctgttgccaggctggagtgtagtagcacgatctcagctcactgcaacctccgcctcctgcgttcaagtgattctcctgagtagctgggattacaggcacctgccaccacacccggctaatttttatatttttagtagagacggggtttcaccacgttggccaggctggtcttgaactcctgacctcaggtgatccacccacctcagcctcccaaagtgctaggattatacaggcatgagccaccatgcccggccttatttttaaattaaaattaaatatatatattataatatgtatacataatgagatatatacacatatatctgtgtgtgtgtgtgtgtgtatcctgaatctgccccccaaaaaatgaaaacaaaacaaaaaaataaccaagtctctcccaaccagtggcatcctaagggtgtatcctaagggtgcagccctctgttccacaaataggtaagaagcagatccatatctatagggaattttaacataatattaaaacaaacccaagtgggcttgtttgtagttatcaccacgcatcggtcattcttcacaactttatttacaaagtacaaagctgatattattgcaaaatgatacagctgcttttgcgttttaataataatattgtatatgagagcatcaagatatttgttgtctttcgatgagccttgcgttccacaggaagattcagggaactgtcacagtcaaccggcaacacagacaggctcaaagacacgtgctctttttgagaatagatttgcacgagtgcagaatcttcattttaggtctctattccccatgcttgtaaatactctcgggtttgaagtgtggactgg[133 bp omitted]gcaacctccgcctcccaggttcaagtaattcttctacctcagcctccggagtagctgagactacaggtgtgcaccaccacacctggctaatttttgtatttttactagagacgccatgttggtcaggctgatctcaaactcctgacctcaggtgatccgcccgccttggcctcccaaagtgctgggattacaggtgtgagccaccacgcccggcccaagttaatctttgaaccatgtagagttcacttatttgcaagcatttctgcatgtggcttttcccttttctcaaaaaattgacataattagaatgtattaatccattacttttccctttatacagtaatattaattttattgtagagatttatgaggcacaatatgatgttttgatatttgctcacattgcaggatgattaaatcgagctacttatttatcacctgacatatttttgtatcggtagtgagaatattttaaaatttgttattctcttatccattttcaagtataccatgctattaaccgtagtcaccacgttgtacagtagatctcctgaacgtattcctcctgtgtcgctgagattttgcatcccctgaccaacatcttccctaattccctacctcactccccagctcatgggaaccaccattctactctctacttctaggacttccttctttagatcccacatagaactgagatcgtgtgatgattgtttttctgtacctcgtttatttcacttaacataatgtcctccagttccatc[132 bp omitted]gcaacctctgcctcctgggttcaagcaatactctcgcctcagcctccagagtagctgtgattacaggcacctgccatcatacctggctaatttttgcatttttgtagagatggggtttcaccatgttggccaggctggtcttgaacttctgacctcaggtgatctgcccgcctcagcctcccaaagtgctgggattacaggcatgagccactgcacctggcagaattttattcttttttatggctgtgtagtaattcattgtgtatgtgtaccacattctctttatgcactcatctgttgatggcatttgggttgattccatatcttggctattatgaataacattgtaataaacatgggagtgcagatatctcttaaccacactaatttcaattcctttggctatatatttatcagtgggattgatgggccatagggtacttctatttttaattttttgagagaactccatactgttttccataatagctatactaatttacgttctcaccaacagtgtgcaagggtcccctcttttctgcatccccaccaatacttatattttatcttcttgaaagtagccattctgacaggtataaggttaccaccttatatcacttatctcaccttatatcacttatctcactttatatcaccttatctcactgtggttttcatttgcatttctgatgattagtgatgtggagcattttttcatgtatctgttggccatttgtgtgtctgtttttgagagacacctattcaggtccttggctcatttttaaattggattatttgttttcctgctgttgagcttttgagtttcttatgtatttttgatattcacttcttatcagatgtatggtttgcaaatattttctttcttctttccctttctctctctttctttctttctttctttctttcttctttctttctttccttctttcctttcttcttttctttccttccttcctttcttcctttctttccttctttctttctctcttcctttcttttctttcttctttctttctttccttctttcctttcttcttttctttccttccttcctttcttcttttctttccttccttcctttctttcttcctttctttccttctttctttctttcttctttctttccttctttcctttcttcttttctttccttccttcctttctttcttcctttctttccttcttctttctttctttctttctttctttctttctttctttctttctttctttctttcttcttctcttttttctttgagacagggttttcctcaggtgccaaggctacagtgcagttctgtgatcacggctccctgcagcctctacctcctgggctcaagcaatcctcccacctcagcctcccataactgggaccacaggcatgcaccaccatgcctgcctaaagttttttttattttttgtagagacaagagtctccctatgtcaccaagactgattttgaactcctgggctcatgtgatcctcctgcctcagcttcccaaagttctgggatgacaagcgtgagccaccatgcccagccaaatattatctttcaatccacaggttgtctatgtctattcactgtgttaattgtttcagtggctgtgcagaactgttttagtttgatgcaatcctatatgtctatttttgcttttgttacctgtgttattatatttttattatttttactgacatgaccatacctaccagtcccataaatgacaatcttcactatgtttctttcctgtccttattattcttcctctaattctataacaattgttgaaaattcttttgttttataaagaaaggggtattttaatataattgactcccggtgtcagatatagtagatataccactgatcttgtcccttctctgccaacaatgagaggcttaaatggtggtgtccccaaatggaataagttactttcctgatttattgcttgaaagatgtactggttatcccttgttctgtaacacatcaccccaaaatttagcagcttcaaagaacagacatttattatatcatgcaatttccaaagatcaggattcttggagaggcttagctggatgtttctggggcaggtgtctcatgaagttgcagggaaaccctctattgatggccccaaagtattcccaagagacccacccaatgaagaatatgccactggacttcctgggagcaaaacataggtttttttgtactaatttgctgagatttggagattattttttgaatactcaatatgggtttttctgcaccaaatatttttcagaaacttttaagagaagttttcaatatgaaaaatgagagtttcaggaaagaaaatttccctattatttatgccttccctggatttgagcttcctggatctattccctgcaatgattccacatagagagctatggaaatatgttcgcaatcctcatgtttatagttaatttcccacaaaagttaaaagaactttcatgactgcaaaactaatgcaagattctatgaaaagtttacttccttttaaaacactgcacgattacagatactgttatttcagctctctttttccttccctttaaatccacagaagtacaaaagaaggtggttttttgagtcgaaatctcactttccatgttgaacagtgcaatctagtagatgctacaataaccaagtaaatttgggattgatttaaaccatatagtggttacgcttctttgatatagatatagactaaaactttcagagcgcatttgctaaggtttgcctggaagaaaaaaaaatggcaaatttttgcatgaaaatggacaaatgtttccccaagcagttttacttgtcttgtataagttatattttattttcaaattgtcatcatatgccgtctttaattttgcctattatgacctccctctgagtgggatgcagaggatcctaggcgaatgagatggaatgtgattaattcccaggctcctgagaatcgggggaagaatgccagcagtgcagtcaggggccactctgggttctcagctccctgtctcggtcctgctcctaagctctgccaaagccctcccaggtcattgcaaccctctcctcctccggcaggggatgcagagggaatccccaccaggtatcacttccgcaaggtcaagggtgaatagacttgagggtgaatacactctcaagccatgaatggactctaaactttgaggtggtgggtagcagggcttgatctggtcaaaagtggacggatttgcaagggttcactgaggtctctgactcaaaatgaccaagaaccgcttgctgttcacgtccaacctggatgtgcatgagttggacttctgcttcttcactgcgcgcgtgtagaactgaagcgggtctttgctgcatcttctccagaaccctggattttacagacagcactgaggtcccttcataaactctgtcttcatcccattgtagagctcactggcatgccattctgctaactcttttcttctgttttggaaaatataactttttatttcaaaatgtgaattgtataaaatgcataagggattttgtgatgttgaagtgaattaataaatgtatgtataatgtctcagtttttctgtctaatataataaatattgacaagtgtaagctccatcagtaaaacctctttgaggtccttgctaattttttagagtgcaaagagtgcttgagaccaaaagagcttgagaaccagggtttgaagacgtgcaaggaaagctaggaaaaggctattccaaggatggtacaaagcacagggggaaggttttctggatatattatgtaatatgtataatattatacaatgttatataatgtataataaaatatattttatgttttatataatttatatgtagtatataaatatattatgcacaatatttattttatatataacataaatatatgctatatatgttatatgaaaatattatatataattatataaaataatagatataatatataatcataaaatatataaatatattatgagtactattatatattatatactatatatgattattatatagtatatattatatatttttatattatatataatatattattaatatacaacatacaaaatataatttatgaaaaaaatataaaatataaatatattaataatatatcatcttatataatacataacatataatattgccttgggtaaccatataatatattacatatattatgtataatgtatattatatattatgtattatatattatatattatgtataatatatattatatattatgtattctatataatatgttatgtccaattatatataatatattatgtataattatatataacatattattatatataatatagaatatatattactatgtgcaataatatataatatattattattttatataatatactattgtatataatatatattattatgtacaataatatataatatattattatgtacaataatatataatatattattatgtacaataatatataatatattatgtacaataatatataatatattatgtacaataatatataatatattattgttatataaaatatattattgtatataatataatctattacatatattatgcaaaaatatattttatatattacatatattatgcatgcataacattatattacatatattatgcataataacaatatatataatatatgcataataatatattatgaatatattttatatattgcatatattatgatatattatgcataataatatattttttatatatatacactatattattatataatatataatatataatacattatatatgtaatgtatataatacattatataatacatattatatatgtaatgtatatatacataatgtataatatacatttatatgtaatatgtattatatattatattatatatcatattatatataatatattatatatttacacaaggcaatattatatgctatgtattatatatgatgatatattactaatatatttatattttatatatttatttttcataaattatatatcgtatgttgtatattattattatattatatataatataaaatatataatatatactatataataatcatatatagtatataccatataataatactcatataatatatttatattttatgattattatatattatatctatcattttatataattatatataatattttcacataacataatatataacatatatttatatgctatatataaaataaatattgtacataatatatttatatactacatataaattatataaaacataaaatatattttattatacattatataacattgtataatattatacatattacataatatatccagaaaaccttccccctgtgctttgtaccatccttggaatagccttttcctagctttccttgcacgtcttcaaaccctggttctcaagctcttttggtctcaagcactctttgcactctaaaaaattagcaaggacctcaaagaggttttactgatggagcttacacttgtcaatatttattatattagacagaaaaactgagacattatgcatacatttattaattatgttttgcaattaaaatatcatatatcatatattatacattacatatattatgcataatatatgtactatataatatattatttgcataatgtattaaatttttattatattaaatatatttaatatatttaatatatttaaatttattatatattacataatatatgtaaatatataatattcacacaaggcaatattatatgatatacataataatatgtaatatataatatattatcatatataaatatgatatataacatatgatgatgtatattatatattaatataatatataattatataaatatgtttttatatatcaataaaatatattatataatgtaatatataatcattacataatataaaatgtatattatacagactatatatatcacttacatatatgcatgtgtatatataaatatatttctatgggtacatatatgaatcatttatgcataagtggtcattgaaattgtaggtgtggatggcttcaggtagagagagatgagttagaaacacaagggaagcttgggattgctccaggggggacatgaaaatgccagcattctctcggagactagaaagcttctatcacttaagctgaatggtggacccatgagggtttgcattattgttgtaagtcttctttggagcatatttaaaattcagtcgcaacatttaacagacaagatggctttacgaaggataaagtaggaagattgattagaagaaaaactgcagggtatcactgtaggaggagaaggaggaggaggaggagaaagatgagaaggaggagaaggaggaagagaggaggcagagggagagaggaagagaagaggaggaggagaaggaggaagagaggaggcagagggagagaggaagagaagagaggaggagaaagaagagcagagggaggaggaagagaggaagaggagaaggaagatgaagagaggagaagaaaaaggaaaaggaagcggcagaggagaaggaggaggaggaagaaaggtctactgccttcacggccatttgagtcagaggagtccccactgcaatcatgatgatgcagtcaatgggaacaaaggctgactggcatgaactcaggaagagtggctgagaacatgcacacacaaaacagataggacaggggaggtgagagcagtgaagaccacacctcatcctgtagtgcacgaatccgtctggacgttggcatccatgacagtgcctccatgaaagcatgaactcttatcccctgctctcatcctggaaaaggttcttgaagtcccctccctgcaacgttcactggaggaactgaaccttaattgctactaagaaaccttttggcagtggaagaaatgcaagataaagtctaattggctgatgactgcgtatgggcccacactcaggaataatttatctttcgtgtttggcagcaaattttcggagcgcagagctaatgtttacatgtttttgagcttgtgtgatactgtaattttgcaaggctttggatgcagatattttgattggcccttttgcttattataacaagacttataataataataaatcataaaacatcatcataactgaattataaggctggacagaatgttaaggagtcagtaagagcaagcaatccttggtactgctggtaagtatttccgggcaactgcaatgttgggatgcatttcataatgtttaggacaatctccccctgtgtctgatgggttgtaaaattcccaaaacttccactctctccacgacacaatttaccaaaaaagttgggtgcattttttcttttgctagggctgctatcaccaaattctgtatgacgagtggtttaaaacaacataaatttattgccttacggctctgaagagcagaagtctgaaatcaaggtgtcggcacagttggttctttctggaggctctgaaaaaatctgccgctgtgttcgcttttggtgaatttcattaatcccttggtgttctttgcttgtagacctggcatccaatctctctctctatggtcactttggtaatatttattcccatccaataaaacaggggtccccaacccccaggccatggaccagtaccagtccaccgcctgttacaaagcgagccacacgacaggaagtgatcagcaggtgggcgagcaagcaaagcttcatctgtactgacagccattccccatcgctcacataaccacatgagttccgcctcctgtcagatcagtagtggcattagattctcataggagcatgaaccctactgtgaactacccatgcaagggatctaggttgatgctccttaagataatctaatgcctgatgatctgtcattgtctcccatcacccccagatgggaccttccagttgcaggaaaacaagctcagggctcccactgattctacattatggtaagttgtagaattatttcattatgtattccaatgtaacagtaatagaaataaagtgcacaatcaatgtaatgtgcttgaatcatcccgatgccattgtcctgccccagatccctgtaaaaattgtctgacatgaaacctgtccttggtgccaaaaaggttggggaccactgcaatacagagtggaaggtgaagtagagtgtacagaaataatccaacaggaaggagctggttgttagctggtgcatgtagccttcttggaccactctctactctttaccgtctctatcttgtcagcaccaatactcatcaatatttcatatggcaaatatgagtttagaatgggcataccataatcaacctaaacaagtgattcgtctattacgacagacactacctactaatactaatgtctcaatacttattattattcatgcattcatgagctatgactattgtaaacatggaggcaagttctttacaactgaatgacctacccaaaagtcaggatgagggaagactccagctcattaactatcaatctagtattcaagaaaaagaccaaatggtgcttgtcaaattgagtttaaaagtctactcctggctggacgcgggtggcttacgcctgtaatcccagcactttggaaggccg[134 bp omitted]gaggcaggagaatggtgtgaacccgggaggcagagcttgcagggagccgagattgcaccactgcactccagcctgggtgatagaacgagactccatctcaagaaaaaaaaaaaaaagcctactcctattataaattttctctgcccagctttaaatgcaaagttccatagctgaaattaattgttggtttctcgacagaaaacaggagcaagctgtgttgagtcacttcatggtatgtcttaccatgggattgttgaccaggataacattttattagacctaattagggattcattagtgggaaatacgcgtatttggatttcgcagatgatgagacatgccctgtttgtttgcctcatcgaattttgacagataagatgcctgggtgaccccgtcaaagggaaattctactgtggtttgaaatattagagccatagcaaagcttgcttctcaaaaacataccagcccaaaggcatatgttttgcataatatttattgcaatatttgggcatgttgatatacagcataaagattctttgccacttgtgccttttgggttaatagattgttatgtctttgatcttctgccaagttaaaggttatttggtagtttctatgaattcagagacaattttacaaaccatcgcctttccagtgtgaaaagaatgcctgggtgaagtgacagtagcaattgcatcttcatgaaacggagcgagaatgcatcgtctcccacgttgggtgaatgggacctgattggtgaggctgacagtttcattggtggtggagaggaaaaacttatttaaaacaaataaatgcattttgccaagggctgtcacctttgccaaggaagctgagtttgaatccaccctgcagaaggtgcaaagaatctttaagcaatatgtaaacatgaccaaatattgtgacaaataaataaacagggaacacaagttttcaagagagggacgtgacggaggaagcagtctcagttaccccttctagcagcaaggctaccaggaggaaggtgctccaaatgccatgggcagagcaggatgaccagaggggcatcctgttctgagcaatgaggggcccagaaaacacagaaacaccttagagagtggctgcattagtcttttatcaatgtttaagcatggattttttacatggaatcacagttatccattccatattgctgactaaatggctacattatttatttttttctgatccttcattctttcatttgtatttggaaacagcaaacactgttttcagatgaccacagaatattactacagtgaatgttttccagcaaaaggtataatattttttattctgtgctagttcagtgcttaatgcatagtaagagtcatgcatacatacatacatacacacacaaacaagtacatacataggcattgtcatggctaattatatgtgtcaacctggctgcgccatggggttcccacatatttggtcaaatgttactctagatgtgtttatgaatattattctggttgagattaatgaatcaatcagtagacttagtagagtggattgtcttctgttatgtgggtaacagagcaattggttcaacggtggtgtcattagggaacagggaggaaagacaagaaaacagaaaagttgttggccactgtggaaaacagtgtggagattccttaaataactaaaagtagaactaccattcgatccagcaaccccactcctgggtatctatccagaagaaaagaagtcattatatgaaaaaggattgtcctctgttatgagggtggacatagaacaaagaaaaaaatggagtaacaaagaatttgctctctctgcctgtcttcaagctgggacaatagttttactcctgactccacattagactcaggctgcaactcttaccattggctctcctgggtctcagaccttcagagtcagactggagctctcaccatcagctcttctgggtcttgggccttcagactcagactggaactcacaccctcagctctcctgggactcagaccttcaaactcagactggaactctcaccatcagttctcctgggtctcaggcctccatactcagactggaactcatgtcatcagctcttctcagtctcaggccttcacacaggaactcacaccctcagctctcctgggtctcagaccttcagactcagactggaactctcatcatcagctctcctgggtctcaggcctccatgctcagactggaactcacatcatcaactcttctcagtctcaggccttcacacaggaactcacaccatcagctctcctgggtctcaggtcatcacactggaactcaaaccatcagctttcctggatctcaggctgtcacactggaactcacaccattggctctcctgggtctcaggacttcagactcagaatggaactcacatccttggctttctcaggtcttagaccttcagactcagactgaaagtcacacccttggctcttctgggtctcagaccttcagactggaactcataccatccgccttcctgggtctccaggcttaataactaaatctacaggcagcattatgggtgaatcttagaaattcaaaattggcagaaaaaaatatataggagaggatgtgctatgttagcaataactatgattcaaaagtgagcaaaagtgaaccataaaatttaatgcacccagataaatttaatttttaatttacaaacaatcaatgtatgtatgtatgtatggagtacagtgtgatattttgaaatatgcataccttgtggaaggattaaattgagctaattgccatattcattgcttcacctacttattcgttttgtgtgtgtggtgagaacatttaaaaatccactctctcagccactttgatttttagttgctttttttgagacagagtcctgctctgttgcccaggctagagcgcagtggtgggatctcggctcactgcaatatctgcctcacgggttcaagctattctcctgtcccagcctcccaagtagctgggattacaggtctgcaccaccatgcctggctaatttttgtattttcagtagagacggggt[136 bp omitted]gtattcatcacatcaactacttattatttctgtatatgtggtgagagcatttaaaatccactctcttagccactatgaaatatacattaccttattattaactatggtcaccatgctgtagaatacatccctaagacttattcttcctctctaactaaaactttgtaccctttgatcaccatcttcccgatctccaaccccgaagcccctgggaaccactgttctgctgtctgtttccatgagctcaattttttagattccacatataagtgagatcatagggtgtttttctgtgcctggcttatttcccctggcatgatgtcctctgggttcatccatgttttcttagtcttaagagagtaccaaggagacaggatttttaagaaaatagcagtgaggggagagggatcaaattgggattgaaagcaattagtctgaaaaaattccaattgcctcttccttccagggtccatcttactgacctagcttgaatgaggtctccaccctttgaggcataaaaccagaaaatggtggtgacagcatagtgcagtcgtagagaatccactcttacgtcagcgagatccattaagggctaaagaatcattggagataggaaactatgcaggaaggattcactgtacctaaaactaatttatattgtgtgtgaagtgttgggtatcttcaaaggaaaatatgcaatggtgtgaaaggatgaatatgcaaagcatgttaagaagcaagccaataaaataagcatggatccaacaacccacataaaaaatggagaatatttctcattcattgttgctttcaaggcttgcttctctactgccttgaaaatcccacagtcaaagttaaatatgttcctgaattttttgtgtaataaaaacataacaattttgcctaagagctctgttttcctaatcaatatattatggtttacttaggctagcatttgaatcatattcactgggagcacactgcatagtctgtattttttcccttccaacaatttgaaatttctgagattcagccatgactctgcacatagatttagtttattcgttttgcctttgtacaatctttcactatgtaactatttcacactttacagatccatccccctgacggtgaacatctgagttgttgcagggttttaccgttacaaacatttctgctaaggccatgcttatctatgtacaagagtatgcaagagttcctctaaagtgtataccagcgaggggaattggtgggtcgtgttctgatttaaaggatggtgccaaagggatctccaatatggttgtactgatttatggtcccagcagcagtgggtgaatgttctcattgtttgacatgtacattagcagacagatttagccataattacatgctgctcgctgacaccaaaccagtttttccctctttagagcctgaccacattttccatctgctcctggaattcagtgtgtgtttggttgagttctggccaaggaaatgtgagtataagcgtgtgtcccatggaaatctcccacgggtgagcttccatgagctttttccttggagttgataaaactgaaacagtggccaaaaaaatcaacaaacaaaaacagggataccttgcaaggcaggtgttggagatggcagagtaccaatttggcaataaacctgagtctctcactcaccacttggagaaaatctacccaagcaagaacacttgcaaagggctagtaaagtaggaaaaataaactatgattgtgttaagccaataaaatcctgtgctgccttttttctattggtgagcattactccgggattctgaatgggatcaaccttgcgcatctaaaatgacggcgttctctggtggcaacatgcatttctgattttctagtgtgattggccaaattgtcactgggttactcagctctcatagttcctctgttagaaagccctacactttttgacctttgctcattgaaagactgtaaaaataattgtgagaaaagatgaaaatatgtgagtatgtatacatcaatatttgtagacttttatagttatcatgcgtatagaatatgggcatacaggcacaaatgtgttcagaaacatggcaattttaggaattgtttaatttaaggtttcttttatttcagggcttttaagaatatccacagagctgcacataatgaaggaagtatgtatatttgtgccctgactgtgaagagtgttataccagttgcacagaaatttgcatggatcagaaccttataagcaaaaaagagcaattccaaattacttttacttccttgtcattgaatgttcctgggtgatagccagaactctacattagcaaattctcgtataattttctgtaataatggaaatgttctatcctgggctgccaaggtggtagcctctagccatttgggactactgagcactgaaatgcagctagtgagaccatggaagtgattctattatttaatttttaattttaatatttgtgggtacatactaggtgtacagatggaagtgaattcttattcctattttattttaaatcctttaaatttgaatgtaattatccacaggcgtctaggggtatgatgttggacaacaccccagatctacaggaacttgccattgaaaaggtcaagcagcaacacttcacctggagtgcagctagaaatggaatttcccaggtcctgctcaggacttactgcatcagactcattcgagagcatgttcaggtttgagagcgttacatgaaccaccatttgcatcttgcctttttcttagagacagggtctcactctgtcacccaagctgcagttcagtggtgaaatcatagcccactgcagcctcaacctcctgggctcaagcaatcctcccacctcagcctcctgactagctgggactacaggcacacaccaccatgcccagccaatttttgtatttttttagaaacagggtcttgctgtgttgcccaggctggtctcgaacccccgcttcaagtgattctcctgccttggcctcccaaagtgctgggattacaggcatgaccattggccctggcctcatcttgctttttttctctttgtcaaccactgtgaaaatctttcacatattgcctggttgttctcttgttgccatttgagcccatttgttctcagaaagcaagtggcattccatcatccccaggtcaaggagccaaggaagatattaggtatcatcagatggctgaagctgtttacagtccaatttgcacaccctgtgaccaagttaccgttaggattctgccattatctgagagtgttggacgttggtcgatacgccattttctcagaccccaggacacttagaatgactcccaagaattccttccccaaatggttccatggttcgtagacattgttgtgttttgtaatggaggtggcatatgtcaggtttgagccagcagaccgtgggaacacagaaaagcagcatctgccagtagggtgagtccagggcgggttcttggaagagatgaggggattttgtgagctgagcctggaagaatgggtactggcaaggcatgctttctaacacttacagaacatttccaaaacagtgacttgggtgagtccccattcctgtatattttatgaagaggctagacattgagaaataatcgtggagtgaggtgagacgttgtgggtgatgacggcatataaatatttgcacgtatgcatgtctgcctagctgccacatttggaacatatgagtctttagaaatgtaagtgtacgaagagctgggcatggtggcccacagctataatcccagtgctttgggaggctaatgagagaggattgatttaagacaggagttcaacaccagcctcacaacacagtgagaaccccatctctaaaataaacaaaataaaataaaatagtcagcgtgctgcaacacacccataatcccagctactcaggaggctgaggtgggaggatcacttgagcccagggaggtcaaggctgaagtgagctatcatggtgccactgcacccctgcctgggcaacagagcaaaaccccgtctcctaaaataaaaactaaaaaatttaagtacaagagcaaagtgatttttggttgatgatagctgggggaggtgacttcagggaaagcaaaataagaacgtggtagatcctaaaatgtttaaaagcatttctatagatgggcgcatgcacaacttgctcttttccttgtcctctgaaactcaggggatactataatcttaaaagtacatggaaaaggaagcttaaatgcatacacactatcaccaatcgatccagcaatctcactccttagtatgtggtaccaaaggagttgaaaatgtatgtccacacaaacctgtgcacacaaatgtttatatggcagctttagtcgcaattatcaaaactatttcaacaaaattgtatttccctttatttaagaaaatagtgtttatattttagaggagttttgggtttacagaaaaattgagaaaaaggtacagagatttctcatatagtccctgctcccttaccccaacttcccccattatcaatatccccaccggagaggtacgtttgttctaaggaacctacatagacacatcattattgatatggtttgtctctgtgtctctgcccaaacctcatgttgaattgtaatccccaatgttggggagggacctggtggggggtgattagattatgggggtggataaaacttggaggttacaaagatgtgcttcaggcagtgaatggataaataaaggatgatacaacctgatcatagaatattattcagcatgtgaacctcgaaaatttgagagaggtctcagttaatttagaaagtttattttgctaaggttgaggacagatccccgtgacacaggctcaggaggtcctgacaacatgtgcacaaagtggtcgtgacatagcttggttttctacattttagggagatatgagacatcaatcaatatgcgtaagacgcacattggttcagtccagaaacatgggacaactcgaagcaaaggtgggaagactccaagcgggtgaggaggcttccaagtcataggtagttaagagacaaatggttgtattcttgtgagtttctgatagcttctccaaaggaggcaatcagatatgcatttatctcagtaagcggagggggcactttggatagaataggaggcaggttggccctaagcagttcccagcttgaattttaccgttagcttagtgatttgggggccccaagatttctttctctttcacaaacactaaaatgaaatgagctatcaagtcatgaaaagtcatggagaaattttagatgcatggtactaagtgaagggtaccatgcatctgaaagggtatctgaaaggctgcatgccgtatgattccaactctatgacattctggagaagacaaaactatggagacggtgaaaaagaaaatcagtgattggcaggtcttgagagtgggagagagaatgcagaggatttttaggggagtgaaactactctgtgtggtactaggatgctggatccatgccattatacgtttgtccaaacccttagaatgtacaacaccaagggtgagccctatgtgaactatgaactctggtgataattgtatcagtttgttctcatgctgctataaagacataccagagatggctaatttacagaggaaagaggtttaattgactcacagttctgcaggctgtttaggaagcatggctggggaggcctcaggaaacttacaatcatggcagagcagaaggcgaatggggacgcaggcacatcttcatataaaggagcaggagagagagactgtagtgaggaggaggtatacatttttcaaacaaccagatctcatgagaactcactcactactacgagaacagcaaggggaaaatccacccccatgatccaatcacctcccatcaggtccctcccccaacactggggattataattcaacatgagatttgggtgtggacacagagacaaaccatatcaataatgatgtgtccatgttggttcattacaacaaatgcaccactctggtggggatattgataatgggggaggttgaggtaggggagcagggactatatgcgaaatctctgtaccatactctcaattttgctgtaaacctaaaactcctctaaaatataaattctatttttaaaaaataaaaggtaataaaattttgttgaaaaaaattattcttggcttgacacggtagcttatgcctgtaatcccagcactttgggaggctgaggcgggtggatcacctgaggtcaggagctcgagaccagcctggtcaacatggcgaaaccccatctctactaaaaatacaaaaattagctaggcgtggcagtgcatacctgtaatcccagctactagagaggctgaggcaagagaatcacttgaacccagaagacagaggctgcagtgagctgagatcgtgccactgcactccagtctgggtgatagagtgagactctgtctcaaaaaaaagaaaaggaaaaatcattctcctgagttcagaaaagaataggatgaggggtgagtagggaggttgtttatatttcccaaattgaaaaccactcgatcaatatggatggatgagaaacagcattttccagacatcattatctacttaggcatctttgaaaattccgagtggagcaaggaaacagcatgaggatccagcagaaggaagtgctgggaacaagctgggcctctcccatggttctgggtggcatagagctgccgggagactggaatttcatggagactttgcatgaagtctgcctcgttgggtcaggtttgtcatcagggtgcaacaccttgggaacagacagccgggtagaaagtagcagggcaaatccatgaggatgtcaggggccgcaagacaaccacgcctaaggaaaaacatcgcaggaaggtcacacttgctttcatttctgaatcataaatgtgcgagatggaggcatatggatggatgaagcaaattaatgaagtgtgcagctgtcctgtcggattgctaggcaatagcaacaaaacccaggcggctgtcgtgaagaatgcagacagcctgcaccaccgcccacagagcttgctgcatgaccaaaccaatgagactcccagaacaagcgggaaaacatgtccagggttctcagaaatgcctcggcagagctgtgcctccggggagttgcattcgccacagagatcctcacctggcgaaaagcgactgcttccctgctcatttccaaaatgagcacctgttgagttgtttgagctgtgacgaatgcaaaaaaaaaatctcagggggaaaaaataaaacgttaaggaattttttttagttgcatggattatcagcctccgccagtctcatgatgctgctgtcagtccgagacctgatgtcatagcctgaaaaactcagctcagcgtctgaggtttcgactcccttcttaacaaaagtcatttgtcttgacctcctagttaagaaaccacaggtatttagaatattgtacaaaaagggactgccagaaaaatctcatacacgtgtgcagtgggctttgctcagatgcgggaaatcaaagacatgttcagacatggcgccctccagttttgcagtgggctaaatattacagaaatggttcaactctgtcaccgagatcatgtgaattaactttgtcctcacccttttcaacaaagggtgctgggataattggctagccacatgcaggagaatgaaactggatcctcatctctcatcttatacaaaaatcagctcaagatggatcaagggattaaatctaagacctaaaactataaaaattctagaagataacattggaaaaacccttcttgacattggcttaggcaaggatgtcatgatcaagaacccaaaagcaaatgcaataaagacaaagataaatatgtgggacttaattaaactaaagcgcttttgcctggcaaaaggaacagtcagcaaggtaaacagacaacccacagggtgggagaaaaccttcccaatctatacatctaacaaaggactaatatccagaatctacaacgaactcaaacaaatcagaaagaacaaaacaaacaatcccatcaaaaagtgggctaaggacatgaatagacaattctcaaaagaagatatacatatggccaacaaacatatgaaaaaatgctcaatatcactaatgaccagggaaatgcaaatcaaaaccacaatgcaataccaccttactcctgcaagaatggccataatcaaaaactcaaaaaacagtagatgtggtgaacaggaacacttctaaactgctggtgggatgtaaactagtaccgccactatggaaaacagtgtggagattccttaaagagctaaaagtagaactacgatttgatccagcaatcccactactgggtatctacccagaggaaaagaaaatcattatttgaaaaagatgcttgcacacgcatgtttatagcagcacaactcacaattgcaaaatcgtggaaccaacccaaatgcccatcaatcaacgagtggatgaagaaaccctggcatatatatacagtgaaatactactcagccataaaaaggaatgaattaacggcatttgcagcggcctggatgagattggagactattattctaaatgaagtaactcaggaatggaaaaccaaacatcgtatgtgtttaaccaaacgtcgtattattctaagtgaagtaattcgggaatggaaaaccaatcgtcgtattctcacacataagcgggagctaagctatgaggattcgaaggcataagagtgacacaatggactttggggacttgggaggaaggctggaaggggagcgagggataaaagactacaaatagggtgcagtggacactgcttgggtgatgggtgcatcaaaatctcacaaatcaccactaaagaacttgctcatgtaaccaaacaccacctgttccccaaaaatctatggaaatataaaaaataaaaaataaaaactctgtcctggaaccaggttggttctgggcattgtgttgtgttgtgccgtggcatgttttgccttgtttgagtggtatctacacagaaccacccaatgaggtgtctgggatggtttgctctcttggtgatctcgaggtgcggtttcaagtgttttgttgtactatgtggtgtcattgcttgttttgccttgtgtgggctatgtattagtcagggttctctggagaaacagaaccaacaggagatatgtatataaagagagaaagattaaaataaagtatattagttcgttttcatgctgctgataaagacatacccaagactgggcaatttacaaaagaaagaggtttaagggacttatagttccacatggctggggaggcctcagaatcatggcagaaggcaaggagaagcaagagttcactgcactccagcctgggtgatagacggagacccagtctcattttcaaaaagaagaatccagtatattattattacaactcttattaatagttgctttgattttctgctcctttatccaatggtacctaattgaacaacatgcagaccaaacaccaccagcagtccactttctataaaacttctaacagggccagttgcagtggctcacacctgtaatcccaacacgttgggaggccgaggcaggcggatcacagggtcaggagttcaagaccagccagttcaaaaccagcctggccaacacgttgaaacccagtctctactaaaagtacaaaaattagttgggcattgtgtgggtgcctgtaatcccagctactcaggaggctgaggcaggagaattgcttgaacccgggaggtggaggttgcagtgagccgagatcacaccacagcactccagcctgagccaaagagcaagactccatcttgggccagggagcagggggtaggcggggggtacttctaacaggatgtagtattttctcttgtaggttggtgcatggtgagaatttatgttgcaaaatgggctgtcatgttgcttatacagatcaagggggccaacaccggtaattgtcaatttttgagtgaatcacatcatgattttttgtgtgtttttactttgtccctggtagattctgcgtgaagagtttcccgtatgttcagaactacaaatgaggtcagaattttggaatttcaagtttggccccatagagtagattgggtaagattgggtttttcacataacactgatttattttactgttgatggggaaagacacacattggacaaaactcatttattctgtatccttcctttgccatttgtaagtatccttgaattttttttttttaaatttccttgccttatcttcctagggaaaaaaaaaggtcagaagataggtctaatctgcctggagcctgaaaaaacacagatcttttcagatcattgatttttgtttgtttgtttttaggtcaagtctcgctccatagcttaggttggaatgcagtggtgtgatcatggcttactgcagcctcgacttcccgggctcaagcaatcctctcacctcagcctcctgagtagctgggactgcagatgtgcaccaccacacccagctcatttttgtattttttggtagagatgaggtctcgctgtgttgccttatttatttatttagccaactatcttcgtattgtgtatggtgttttcctatatctgattcaagaatgaatacaaagatagattttatctggagatattctacaaagtttaaaaccatacagtgaatatattgataattctttggtcaaaagtggttctggggtgtatttctctattaaatacacctggagtacatttccttattaaataagtctatatgagaggaaggataagttcaggggttctattataccacatgatgactaaaataaacaacaatggatcacatacttaaaaattgctaaaagagtagattttaaacgttctctccaccaaaaaatgagaagttggtgaggtgatgtttatgttaactagtgtcatttggccatttttcagtggaaacacatatcaaagcatcatgacgttactgagttcatgcggtggctcacacctctaatctcagcatttaggagtcccaggctggaggattacttgaggccagaagttcagaccagcctgggcaatatagtgagacccccatctttacaataaatttaaaaaattaaccaggcatggtggcgcaggactgtagtcccagctactgggaaggctggggcaggaggattgcttgagcccagaaggtcaaggctgcagtgagctatgacgacaccactgcactccagcctgggtgacagagagagaccctgtctcaaataaaagcaaaaaaaaaaaaaaaaaaaaaaaagttgtgcctcataaatatacaccatttttatttatcaattaaaaaattaatttttgaaaatcccctccttttgaaaaatgagtctatatgaaacatctactatatcacaggtaccatgattatatcctgtatattagggacataatatctactatataatggatgctaaaattatatccctatatactagggatatgatatctactatatgacaggtaccgggattatattcctgtatactagggatctaaaatcgactctgtgatgggtactggaataatatccctatacattggggatatcaaatcgactctgggatgggtactgagattatatccctatatgctaggaatagaaaatctactatatgacaggtactaggattctatccctacatgccaaggatatagtatctactatgtgatggatactgtgattatatccccatctactagggatagaaaatcgactatgcaatgggtactgggattctatccctaaatactagggatataatatctactatgttacaggtactgtgattatatccctatgtgcgagagatgtaaaatcgactgtgtgacgggtactgggattctatccttatatggtggggatagaaaatcgactctatgacagggattgggataatatgcctatatactggggacataaaattgactatgtgatgggtactggcattatctccctatatactggggatagaaaatcgactgtgtcacgggtactagaattatatccctatatggtagggatggaaaatccactgtatgacaggtactgggattatatccctatatgccaggcatataaaatctactacgtgatgggcactaggattatagccctacatactaggcatataaaatctactatatgacaggtactaggattatatccccatatacaagggatagaaaatgtactatatgatatgtactgtgattattactagggatacacatcctgaagatgtagttcctgggctcgagagaaacagcctcagaaaccaacaattcacccatgggtgtcacaggaggtgtcatgaagtacagagtaagggctgggtaactcttaggaaaggtgcccccagagagtgagcctttaaccaagatctcaaacaatgggtcattgtttgccagaagtaggggcaggggtgtaggagggagagagggagagaaaaagagagagagaggcaaggtctcccacgcaaaggaaaagagcctgtgcaaaactatcacagctcatgaatgaccaggatgaatgtggacagatgatattctcttgtgtgtcaggactaaagaaaatgttatatttggcaaagatccatggaggtagggagtgcaggcagagaatttctgcgaaaggagctttaggagtttcctgtgccaccataacacattacggcaaagcaggtggcttgcaacaacaaatttattccctttcagtttgaggggatgcaagtcagaaagcgaggtgaaagtggaaccatgctgtctctcaaagctcaagggaaaaatcctttgcctccttctcagtttgcatgtttgttggcaatccctggtgtttgtttgcttggggtggcatcctccagtgtctgcctctgcagttccaagaacttcccctctctgtgtgtctgtcttttctactcttcttataaggacacctatcattggatttatggtccaccctagtccagtaagacgtcaacttactgcaaattcgttatatctggcaagtccttatttccttttttttttccttgcttaattttaagttcaggggtgcatgtgcaggtttgttatttgggtaaacttgtgtcacaggggtttgttgtacagattattttgtcaccctgctattaagcctagtacccattagttatttgtcctgatcctccccctcgtcctcatcctctaccttccaggccccagtgtctgtttgtattagtccgttttcacactgctgataaagacatacccgagactgggtaatttataaagaaaaagaggtttcatggactcacagttccacatggctggggaggcctcacaatcatggcagaaggtgaaagccacatcttacatggcggcagacaagagagaatgagagccaagtgagaggggaaaccatttataaaaccatcagatctcatgagacttattcactaccaggagaacagtatgggggaaattgcccccatgattcaattacctcccaccaggttcctcccacaacacatgggaattatgggagctacaattcaagatgagatttgggtggggacacagccaaaccatatcactgttggtcccctctatgtgtccatgtgttctcatcatttagctcccacttatcaggacgaatatgcagtatttgtttttccattcctgtgttagttggctaaggataatggcctccagttccatccatgttccttcaaaaacatgatctcatccttttttatggctgcatagtattctatggtgtgtatgtaccacattttctttatccagtatgttactgatgggaatttaggtagattccatgtctttgtgattgtgaataatgtggcagtgaatattcgtgtgcacgtgcaagaccttatttccaaataggtcacattctgaggttacagatggatggaaattattaataataataaacccagtacagccagtttgggtccagagtgggaaggctcttgtataaactactaagtgatacaaaacctttttgacttttccaccactgagtttaaaagcagaggtgataacagaagatttgcaatccccaactttatttccacgttatttatgctgaggagtatttaactaagggtaccatccttttcagagactccacccacccttttgatactgatatggacaggggacagggaaatactgggtggagaagggcacagtccctggtgaggtctccaccctcaggcctgtgcccatggacctaaatgagaataggcacccctgttttcgtgcccaaatgctgcatttcccaagatcactctggcccgccatgccccccattctgtgccccatataaacttgagaccttagtgggcacacacacaagcggctgaacatcgagaggagcagaccagcagacaagcgatggcggaactatgcggcagagaaagagagaaggcaggggcacatccggacaccgacgggagttcggcccgggaggtcagagaagagtctggctgcggggtggccgaactccaggggaagattattgcccctacctgtctctataaaaaattaaaaaattagttgggcatggtggctcatgactgtggtcccatctacctgggaggctgaggcaggaggatcacttgagcccaggaggttgaggctacagtaagctgtgattgcaccactgcactccagcccggctgacagagtgagactgtctcaaaaaataaataaataaataaatatttttaaggaacaattcatgaagactttccaatttgttccatttcatgtgttagcttatttcgattttaaacgagaagacaggagtgataaagtttgtacttggatcccctgatgaatgttcatgttttaatatacttagataggcatttttttccatcacaaatgagattatgtcaatgtgtcctgggaaatactaggaaatttgcatttgattgcaaatcaaaaaataatgaaatttcactcaaaatgtattttctgcataatgcatttttatgatactctggagattgtttaaagaggcatcgttatgaataagtacatattcatgcagacagaaacgcagtgcaggatctaccataactaagacctaatttccaccaggaaatccaagctcgtgtctgcctaatcacatgcttgtttagtaattgcaaattatctgaactccaggcttcttctggagactccaggggcttcttttaatcagtaccggaagctgagaatcaaggaaatcactgaatttcatattattcaaatatatttttcattgcaaatagtacttcattaagaactacaagtaaccattttattttatttttcgttttaccatttttattgaattagtatttcagtattttctgcagacatttggtattttttaaaacatttttgttttccaattgtatcgggacacagacatacacagaagtttgattacgtgaggacacagggagaagacagcatctacaagccaaggagagaggcctcaggaggaaccagccctgcccacaccttgatctcagacttcagcttccaggactgtgggagaatcattgtctgttgtttataagcctcccagtctgtggtattctgtgatagcagcctgaaatgaactaagacatctcataagaagaggggataaggacacagacacacacagagggacgaccctgtgaggacacagggagaagacggcacctccaagccgaagagagaagcctcaggaggaaccatccctgcccacaccttgatcccagacttccagcctccaggaccatgggagaatcaatgtctgttgtttaagccaagcattctgggggacctggttatgcagccctagcaaactaacatagcaagcattattttctctcccatatctcagggtaaatcaccttcctttaaaatggtaggaccctatttcataaaaatgcattccatctctcgtgtgtatttttctcagggtaataactatgagtagagtctcacaaataaagttctttacctaaagtataaaactagccttaaccactaaaccctgaaagttcattttagattttcaatgtaataatagtttttacaacaggaaaatcaaattccgttataataatctgaaaagcaccctcaagtacatcatgttcttattttaattcttcttttactcatacaattctcttagatgaaaaaaaaaaagaagaagaagaagaacctccaactgtaatccaagaaattgtggctgggcacagtggctcacggctgtaatcccagcactttgggaagctgaggcaggtggatcactggaggtcaggggttcaagaccagcctggccaacatggcgaaaccccgtctctactaaaaatacaacaaatgtccaggtgtagtcatacgcgcctgtaatcccagcaactcgggaggctgaggcatgagaatcacttgaacccatgaggcagaagttgcagtgagccaaggtcgtgccactacactccagcctgggtgacagaacgagaatctgtctcaaaaaaaaaaaaaaaaggaaattgcaataggaagctgccacatccaagtggctacatttgtgaattaggaggataaaggaaattgaagaggaggatgacaagaatgaggcctcaaatgtgctgtttgttttctcttctaatgggtgtttgcaaaagagtggcccgtataagagaaacttaagctgttaaaataatttcagtatgcaatctttggcttgtctttcttcttggtattatgagagtgtcattccagagttagaatggtgcttctaggaaacccaagaaaaatatgttcattttcatcaaaaacataattggtgcatttattgagagctttctccatggtcacgttaatatcacagaaaactccatgatagtttgctgagcaaagcaaacagtgttcaaacgcagcagtccccaacctttttggcaccagggacaggtttcgtggaagacaacttttccatggctggggttgggagcaggatggtttcaggatgattcaagcacattgcatttattgtgcactgtatttctattattattacattgtaagatacaatgaaataattttacaactcaccatcatgtggaatcagtgggagccctgagcttgttttcctgcaactagacaatcccatctagtgggggatgggagacagcgacagatcatcaggcattccactctcataaggagcgccaacctagatcccgcgcatgtgcagttcacaaaagggttcacgctcctatgaggatctaataccaccgctgatctgccaggaggtggagctcaggaggtaaagtgagtgatggggagcagctgtcaatacagatgaagctttgctcgcccacctgctactcacctcctgctgtgcggcccagttcctaacgggccacgtggggacccctgttttaacatatatcatttctaatctgtctccccaaatctctgtaatataaagattattgttcccaatgtacatcaaaagaccctgtagggcagagatgtaaaagcatcagcctgatattctgttgctggcatatatcatagatggtcatcaaaccctaattttatacagttgcataaaagacatagttctaatatttgatagcagggtaaggtgcctatagttagcaataatgtattgtgtattttaaaatagctagaagagaagacttgaaatgttcccaacacatggaaatgattaattctcaaggtgacagatattccaaataatgtggcctgatcactacacattctatgcaagcaacaaactgtcacatgttccccatagatatgtaaaatagtatgtatcaataatagaaaaaaggtaaatgcaagcaagtttctcaaaaaattctcagtttcttcaagtatctggtatggtccttaaacccgtaactccctgtgcaagaagtcaagctcgattttggctagggtttgtggggcgcctgatgtttagtttgcacaccatccaatttcacgggggttttttgacgtatttcatgcttcactcttctgcaaagcatttggtcctaagctcaccatgagctccaaagggtgggagcgtccatgggaaggaagggcttctctggggtcataagcattgctttgctcagaagcaccctgggcggatggaattctgggcaaaggatgccaggacatgaagggttttcttccagccccaaacttaactctcctggtatgttatactgcaaagaaggctgaaatacgagcaaatggccgatgaggggatgcactgagaatgaggcaaaggagtctggctttcccttttcctgggatagctggaaggatttgaaggattttgagcatgagagaggcgtgagtagagatgagctgctcagacagaagttggcctgtggtttggggtcctctagacaggaaaagattagaagcagggacaccactgggaatcaacaaatgagcgccaaaaattcacccaatcaaaatggcaggaaatggcctcagaataccttgaatgctgaagatgccttgtaagtgttagtcaaattgaatatactttggatctggaggtataaattatatattatgtataataggtgtgttatatataatatatattataataatgtaatatcttaaatattattataatatataatacttaaatactatatgtaatatatagtatttcaaatatgatattattataataaaacacaaattgcatattgtttatttcatattatatattaaattgccattactcttaatggcagaaaccccaattacttttgcaccaacctaatatgtactatataactatatgatacataacataccattgtatgtctatgtatattatatgtaatatactatgtaatatatattatattctatgtaatatattatataccatgtaatatatattataattaaatatgttatacgtaatatatatcatatacataatataatgtatatgtcatatattatacagtataaggtgttatatatcatataacatatggtgttatgtctatgtatgttatatacattatatactatgcaatttatattatatactatgtagtatattatattataattatgttatatgtaatatatatcatatacattatataatatatgatatgtcatatattatatagtgttaggtgtcatatattacataaggtatagtattataaattatgtaatagataatatagttatatattatataaaatgatgtaaattatatataatatatagttatattttataaatatatcttatatcatatataacattttatatcattttatgattatattatttattttattattatttatactattttatagtatttatattatatattactctttatacatttaaaatattacatattatttatagataacattaaatttcaacagcaatttattatatataacgtacatatacaaataattgtatataatacacaatataataaataatgaaatttttatcaataatgatgacttcaaaacacaaaatcaaaattgttatcggatgtgatgtcaaaaggctgttgttattaagctccggatggaattgacctatcttattgggcacaggtggaaagacagaatgcattttcctattaatatttaaccaagatctattgtgcttatatttgaagcagcaatagcaccaagaggacatgatccctgtcctcggagtcacacatcatccaaaaactcacataaaataagatactggggatgaacttagaaagtgctatgaaataatagctgggcatggtggtgggtgcctgtaatcccagctacttgggaggctgaggcaggcgaatcgcttgaacccgggaggcagaggttgcagtgagccaagatcgtgccaccgcactccagcctgggcgacaagggaagactccatctcaaaaaaataaataattaattaattaaaattaaaaaataaaattagtaataatcacaaatcacatagcgatgagcttcctggaatccaaaggaaaaaatgagacatcttctgtgttatgattaatacaattctttggtaagaaattaagcaaagcttttccagtcatatctgagtcattcataccaaaagcgtcttcaacagtacccccacagaaaagacaggatcacaacttaaaagtgcaatctgttacaaatattctcattttagagctcagtgcacaataagaaagtactgctcagcagtagcaattctgtggagaactacagcagaagtggtctaagaactcagcttttggatggtccagattttactttactgtaaataaaatctatgctatccaggaccatgagtccttcaaaacatgctcctccaatagcgtgtctctcaagtaattgcattttaggatcatatcgtctggcagaagcatggacaacctgcatttttctgcggttgtttaagggcatgtgcatcaaccctaatgatcgaggatgagaagagcgtggttacaaccctgcaaaggaaggttcatggcagaatggctgctgggcttccctcagtgcagctaatatgtttcttaaaaatgaaagtcctctacactcctatctatctatcatctatctatctatctatctatctatctatctatctatctatctatcatctatctacctaatctgtatttctatctatatctatctctgtatttctagctatatctatctatctgtatttctatctatctatatctgtatttctatctatctatctgtgtttctatccatcatctatcatctatcatgtttttatctatctttctatcatgtatcatctatctatttgtctacctatcacctattatctctctatcttctttctttctattatgtatgtatcatctatctatttttttctgtctctgttctctacgtctatctttgtatttccatctcctatacacacacacgcgcacacacacacacatacacacacacacatcaaatctccaatcttctgctcccttgggcaatatagttagataattttattataggaagtgtgtccaaggaaaacatagaagtcactggtcccaaccacagaaatatttctatcacaaagaacatggattgagcaatgcagtctctttgtgaagaatgaggatccattttatgcaaaagataacttaaaatagccagaaccactgtatggatttcctgtgcgtacactcatttcatcttggtgaccatctgctaaaaataattatatgtattctcaaaattttatcagaagccactgttaggacaatggcttcattgtaggaaacactgtccattgattcatcacttaattatagtacggttgacctttgaacaacacgggtttgaactatgtggtccacttagaaggggattggatcctcttccacctctggcaccagcgagtcagcaataccaaccattctcttcctcctcaacctcctcaacgtgaagacaatgaggatgcacatttttatgatgctccacttccactcaatgaatagtaaatgtattttctgttccttattgttttcttaatgacattttattttctttagcttgctttattgtaagaatacagtatttaatatgcatgacatataaaatatgtgctaatcgactgtttatgttatcaggaaggcttccactcaaaagtaggttcttattagttatgttttgggagagtcaaaagttacaagtggatttttttttttttttttttttttggagacggagtttcactcttgttgcccaggctggagtgcagtgactcgatctctgctcactgcaaactccgcctcccgggtccaagtgattcttctgcctcagcctcccgagtagctgggattacaggcacacgccaccacgcttggctaatttttgtatttttagtagagacagggtttcactatg[137 bp omitted]aactcccacattgttcaagagtctactatacattaatatactcttggggtgtgtttgttgttgtaatactctgagtgttggagaaggtacagaattattcacctcctctctcttacctgctgtggaaacagggattctgacccctgggctatttcccatggtgacatcaattaatttcggcctcaactcctaaaaggagccggaacagtttagtacgtgtcagatcgtattggatgaccacatcaccagctcaataaagagccaaatttagccatgacaaaaaactggtgaatctcacagaggcaagtatgaaaagactcattgcaatgggtttaacaagaaggtgactctactgtaaattcccactcactcaaaattcctgtgattgggaagctcatgcaggtgaaatttgtcttctgtccttcatctgaaagaacaattaaacaaatcccaagaatctgcttaaaaggtgtgttgcaggcattctacacaaccattataaggttgagtagaattaagtatccaatgcaatggacacctataatgatcattctgagttactgtgagatagtgtatagaacaataacaaatttgaacacaattaaatataaaagtaaatatgtgcaatagtgactcgagctgggtataatgtaaccatgatttggaaatagcacatctgtaatgaaagaaacagaagatgctatgtctctgctccatctcttatagctatagcttcttcctgaagaaactctcatgtggttttcatatgaaaaatgataagagcagaatatttgaactttcttagctaatatgctcaatggatgaatgaatagatagagagatagatgatggatagatagattagatagataattgatagccgatagatagatagataatagatggataggtaggtagatgatagagatgagattttgataggtaggaaagtaggtagatgatggatgagtagatagataagcgatggattgataaaggtagaagacatagatgatgatagatgatagatggatgtagatgaatagagagatgatagatgagacagatgatagacacataagataacagataaatggataagatgagataaatggatagataataaatagatacatagatggatacagagagacatgagagttgaataggtagggaagtagttacatagaaagcttgatagatggatgagtagatagatggataaaaatggaagagatagagatagatacgagatagacaatgatagctaaactaataaatctaatagctattacatatgatatgaattcatacttacatccacacagttgaggtttgcgtgtagaggaatagttagatgttagcaatttgtactgaattacaattgtactttgtgtatttaagtgtcataagccaaattctaaataacctaatccttttaaaattctcaattcaccagaatcctgagttaaaaagaactcacaaccctccaattccaaataatttctcgagagtaatgatgcagttgagagaaacccccagcctctgtgagagaggaaacttctccactgcgttccctggaaataggcactctttggggctctcatttgcctcgaactaatgattttgttctctttgtttgcttatgggggaaacaactatgttataaatcaatgagttttagctttgtgcgctgaatctggagatccgacacttttggaaaattatttttgaagctgacctcactcatctgtgccggccttggcagaggctgtggttagatgctggttctgctcacatagatatgccacatggaaaaaaataaaagtactttcaacaaaccgagaagcggtgacccagacataaagaatgagcatttgtttccagtgtccgctggtgactcacttcactctgtcattggtcagagccttcccgttctgaggcacagccctggcaaaggcggggttctggaaggacagggcttgcctgggagataatgattcaggaatcagacaggggggcgggtgttcggtaattgtatcactccaccctcagcgtgagttagaagaggattgcactccaacttctgctgcaggtcttcattctctgctgtgtgtgtgtgtgtgtgtgagagagagagagagagagagtgttactctgtcgctcaggagtgcagtggcacgatctcagctcactgcagctttgacctcctagggtcaagccatcctcccgcctcagcctccggaccagctgagactacaggcgcaaaccatcatatgcctggctaattgatttgcattttttgtagagacagggttttgttacgttgcccaggctgatctcgaacccctaagctcaagcaatctacatgcatcggcctcccaaaatgctgtgattacaggcatgagtcaccacacccggccaccattctctgcttttcacttgagtaaatgcatttacaagcaagggtgagctctgacaaagaaagctcttgcccaattccacaaacagaaaaaggatgagggatgagtattcaggatactgagtatcttgaatatagtggaacatctgggttttggttttttgtttttgagacagagtctcgctctgttgtccaggctagaatgcagtgatataatcccagctcattgtagcctcgacctcgtggactcaagtgatcctcccacctcagcctcccgagtagatggaactgcaggtgtgcagcagcacacccggctattttattttttaaatttttgtagagacggggtcttactatgttgcctaggctggtctcaaactcctgggctcaagctatcctcctgccttggcttcccaaagtgctgggtttacaggcatgagccaccactcccagacctggttttttctaatatcctttcctttgacactcatttgttaggggaatgcatttattccttagggctgcggtaacaaattgccaccaatgtaggggcttccaacaacacacatattgaacctgccattactttcgcaccaacctagtacatactctcacggttctggaagttggaagtcctgaatcaatactaccaagctgaagtcaaggttatctccatggttgtgctcccttggaaagcctgtggggaggatccttccttacctcctccagcttctggcggctccatcgtcatcactccgatcctcaaggccagcctctctgaattctctctgtgctccatctcgcaccatcttctcctctgtgggtgtgtcaggtctccttgtgtcttcttcacattaggatccatgtctggcaatttaggagtcaccactgctcggtttgttgaaagtacttttactttttttccatctggcatatctagttgagtggaaccagcatctcccccacagcctctgccaaggccggcccagatgagtgaggtcagtcccccaaaaataattttgcaaatgtgtcagatctctagattcagtgcacaaagccacaactcatttattaatcatctagttgtttccccctacaggcaggattatctgcccatctcaagatttgtaccttacacacatctgcaaaaattcttttttccaaataaggttccattcacagggtgtagagaggaacagctgatctgtttggggaacattattcagactatggctgggaatgggatgtcgccattttggaaggatgcatttttcaaaaacaatttcaacttttatttcagattcaggggatatttgtgcaggtttttttcctgggtacattgagtgatgctgaggtctggggtataactgatgctgtcacccacgtagtgagcattagcacccactaagtactttttcaacccttgctgctatccctccctccctgctctagtaatccctggtgtctcttgttgccaggaacgatgaatttttaaattgatgtctgtcccaagtatccctgggaaagactgggagtgtggttacattgtggtcagcagtgtaatgctgtttctctgctggaaaataaagaagtggtgttaaaactgaaagagatcttgggaatcttccccttagagcttacaaatatctcagccaggtccttgggaggtcagaaggaccgaatggggccaacccccaccccaccagcatctcctccacccatgctgcctgaccaagagaaaattaaattatcttttactgtagccaaattctcgtcaattatcctctcttccatgtttgttctgttcttccccctcctggaagacagaatgagcctttactgcatgtgaattgttggctttcttgccagcccaggtcctgacccatgggctgtgcttgaggagcctttggagtcttttgcaggaggacagccataccagcttgaagtagaccccactcaagaggcaaaagactcctgaacaagctcatattcaagtggttccaaagtactaatgtataaggggaaaaaaaagcaaatctcagctctccaagtagagaaagaatgttttacagctatttaaacatcggtaacaagaaacccttgacataactagcttctcccaaacgagcaaataagtactcttactaatgtaagaaacatgaataaacacgagagaattccaacaaaactcaaggggatcaacttttttctttaacttttcacatctggagctttcaaattctgtcaatttagcatctaaaaaaaataattgacacatgttcagcatatccgtatgcaatcaaggtgctgccattaaacatcatatgattcttttcatagcttgataaaaataaattatatcatagcgtgggggcatttgagatagactgtatgaattccctttgtattaatgttttctatatttttcatatttccagatagtttcccccaatgacattggtaattctgttttgttttgttttttaaatgataaagagagtttagcttacacccttaggtctcagcaaactcccttggtgatggtgagagaaactttccatcattaacaaaaaacatatgctgaggtttagatgacatcaatccgattcctgtggaatgatgggatttgggagttcagtgcagttagacaaaaaaaaaagagagagagagagagagccttacagtttactcagaaccataatttacatcaaggggaacagagagaagagaataaaagaccattaataagaatctcttttcattatgtcaggggacatgaggcaataactaataagaactgagacagcttatatgtatggtgttattgtgatggaatgtgtagcatcacccatggcaagccacattcatcttagatacaaggctattttcatatcctcaggggaatcgttatctccagggtgttgggttcattcctccctcccaaaaccctgctccgctcacccattctaatctccctgttggcctcttcgttggtcatgtcttgaccacagacaccacctgactaggctaacactcatgttctcctcctcctgctcactctctcttctccttttctttcaacaactttacatgaatcaaagatgccagatggtgctagacatttttagaaggaaaaaaaaacacatggaagatgttctcaaactttcctgccttcactaagaagttttctcttaacttgctctttcccaaaagctatcgtctactctctcttcttcccgtcactaccaaatatcttcacccatagtctacgctcattttctcccatgggttatggctcccgccgtcttcattactctgtgatgctgcccttggaaacatggttgagatctcatttccaacccaggaactcattctcaagagtttatcttctttgggcttctgccttgtctctctcttctgaaatttattctgaaacctcccctggtttccacagtgtcctcctttcctcttcctggtagcgctcatacttcccatatctatcattatattttattgttttctctcctccacatacccatatttgtaagagtttacacttggtccctttctttttctctgagacctcatctacttctgctccattaaatatctcccatacacacatggctccccgggtctttagcctttccctggtgagactcaaattgtcattgatctactgaatttgtttacttggatgcctctatttaactcaaactcatatttcttagcccctcacctcatcttagtcaattttatgctgcatcacaaattaccacagactggttaacttatgaagcaaagaaatttattctctcacagttctggagtctgggaagtccaaaaacaaggtaccatgggtcaggacttattctcctagagtctacagaatgctgccttgaatgctgggccttccagaggggagaaaggttgtgtcttcgtgtagcaaaggaacatgggggcttgttgtggggagagacagaggaagagagagagaggagaacccactcccacccaagctcttcttctggctgctttaatgcactcatgaggtggagccctcatgacctaaacacctcccattagtctccgcctcccaaaactgttgcattggaagttatgtatccaacacatgcattttggaggggacaaaaaccttcaaaccatagcattcccttcatccccactgcaccaccattacatgtcatatctcaaggagtcactatctgtttatccaaatgagaaatcatggccacattttttagcttccatgtccaatcgttatcctcacatcagacctggcaaaatgttccaccaagtctgtggataacttccctctccaatctttccctttctccttagtccctctgctgttttcctggttcaaatcatcatctctctgaaggctaagacagacactggtaactcccattctctcctttgtattttttgtcatggagtgtccccccaccggccaaagtttttgctgggcacgtctgcctctgtagggatacctttccgcagcctcccttgcaggtagtggcagaatgtgaccaagtgtatcagtgagctatgagaagaatgggctggccctctgctgcccttttttttttttttttttactttcctgagggctagttcctgtagatattgtttgctgagcatgtataacactctttggtatagcaaagacagcaatgagagctaggttccctgaaaagactttcctgtgtacctactaagccacatcggacctatacttagaaacaaatttatctctcattggaagcttatatcaccatcatcatcatcaccttcaccatcatcatcaccatcaccatcaccatcatcatgactatcatcaccaacaccatcatcaccatcaccatcaccaccatcaccatcaccatcaccaccatcaccatcaccaccaccatcaccatcaccatcaccaccatcaccaccatcaccatcaccaccatcaccaccaccatcaccatcactatcaccactaccaccatcaccaccaccaccatcaccatcaccaccaccaccatcaccaccaccaccatcaccaccaccaccatcaccatcaccatcatcaccaccaccatcaccaccatcaccatcaccatcaccaccatcaccatcaccaccaccaccaccatcaccatcaccaccaccaccatcatcatcaccatcaccaccatcaccatcaccatcaccaccatcaccatcaccaccaccatcaccatcaccaccatcaccatcaccatcaccaccatcaccgtcaccatcatggtcatcaccatcatcatgactatcatcaccaacaccatcatcaccatcaccatcaccatcaccatcgccatcatcatcatctaaattttctactttatttaggtctctttggttttccccaatatcctctttctgttccagcatcttccaagatcttacgttacatttagttatgacatctctttatgctcctcttggatgagacattttcttagacattccttgtttttgatgaccttgacagtattgaagacacttggcaagtattttctaggatatccctcagttaggatctgtcagtttttttttttttttttcatgatcagactgggcttacaggttttggtgaggaaaaccacggaagtaaaatgccacgttcattgtatcatatcaagagtgccttcaagaacctaccagcggggattatggcaatggaccataaaagttgtcattggcagtttccaaattaaggttctctccttttcttttctttttggcttgttctgcccgtcattagccaacgcattaagattgcggtatatgtcaccacctagatttaactgcatttggagaattaaggtagaggcttatgtcatattttggatgctgtgtattgatatcataagtactagtgaaggcacccacaaggaataaacttttccccagtgtctaagttagactcaaatcatattgtttgggcattaacacaaagggtaagccctgaagaataaggaggaggagaaaagggagaaggaaaagaggaaaagcaggagatgaaggtagaggaggaaagagaaggaagaagaggagaaagagtaaggaaaaagggagaaagataaaaatgttaaggtcactctccccataatggattagacacaaaaccttgttccacagaagggtaagtctggaaagaattgaagaaccacagctcagttttgcaaagggaaagggtatgaacccaagtagagacaggacaagtttgctctgtgtttgacttgttttcaacaccattccacccatgaatgccaccatgcgcttgcttcaatgtcaggttgaggaatcagtctaagcaaacttccttcatactttctactatcagcccaaccataggcagattatctacagttattcattcaacatttatcttattggcaagtctccttcctgccttcctcctaccttgcacaatattgaatctctgcatttctatttcccagttacattttgatttttcagcaagatccatacatccaggcatcgatgtgagttgtcagcaggtagtgggggcagagtggatgctgaaaggccccagagctccttaaagctgagtccctttgcttgccaaaatgctctcatatcctgttttgcatgccacgtgttagacagtacattccatccagtggagatacagctgcttgtatcattgcaaaccagctaaagacacgcagccccggcttctgcagaaattggctaggatgcgagttaaattgtcccaatttgctaatgaacatacagaaggaaaaaatcttttcagcttggctggttagttgcaaaatatgtcattttctcattcacataattgttgggcatgatcaagtggaaaatgcaactatttttaaggtactcttttgccatataatggtgactctttaagggtacacatcaggaagatccatctgggaattttttttactaggtagttaagattttctcccctcccccagacctactgaaaaaggatagggtgcatgaattttgataatgttctccctgggattttgatttctaatcctggataagagctctgcttgaaagaagtggggtgattgggtttagggctgcttccaacactgaagtttaggattctatgaagctttaaatttggatggagtgaagaaaaacccagacatccattaatgttaataaacagctgcacattaggaaagtagatacactcataaactaaaatatctctttatttttgtttcctggcatgagtgcattcacctcagaaacagtctctatggaagcggccaacatgtagtccctactgtgtttatccagcccacttcctcctcctactctccaaatatcttttgcattactctcctcaacccactaagtgatttctgctcatctctctttctgctcaacttcaaaaaagaacattttatattggattatggtgatcagagaacccgtaaagaccttatggtcttatagcacatgtttggcatcattactatcattacataggcctgatgtttctgtagatgagtatctatagctatagatagagctatagatgaccaaacaatcaatgagctcgctgctcaatgcacatagagactaataccatgacactggcttttgacaaaagaaaagctttatcgtgagtcagctggcaaagagacaggaggtaatgctcaaatctgtctctgtgagctgggctttgggtcaggttttataagcacaaggtaattagacaagatctaattggaccttgcaatgaagtgatgccatgaggcatgatctgattggatcttgccatagggtgacaacagggttcaatctgattggatcctgaatcttgacacgtggtgtctgcttcttagttcagtccctgctcctcagttagctttctctcaagttgcatgcttggttcatctgggcacattcaggttacatgatcctcaatgtgggggttcatggcaactgaagaacaaatcacaattttgctacatgaaagttgagccagatttgtctgatgtcgtttatatatataataatatgtacagacacacacacacagtttcatgttacttaattggtcacttcttaggtgtcatttttttcagttcacaaaccgtaaaaaattataaacttaataaggatgtccattgaataaagacagcacttttagctctcagacattaggaatagcatgcattttatataagtttaacaaagaaacagaataacttggactgtctaccattactagaaaaccagagagatcaaggaagtagagtgcaagaatgttatctggacatccaccgagggtggccaaccatctagttgactcagaacttaggggttcagtgctgaacacaccctgggatgtggacattcaagctaaaaccaagaaaaccacaggcaaaccagtgtaagccggccaccatacttatgcttccggtcaagatggagtaacaaaaacagagttttccctccagcctcaaatgaccaaaaagtaaagagtcaaccatttaagggagaactattttcaagactggataccaggcagttaaggatagtgattctcaaaagaagattaatttttaaaataaagggaaaataaataaattttcaaaagagaaaaaaaaaaaaggacggtgattctctagaagcagaaaaacaaagtgagacctatggtggccccagctcactgccttgagagcatttccaggctatgactggaaggcagaaactaagagaagcctggaaaactccccgagttgaggagatggagctgagagaacagcccaatcataaatcaacctactagaaagcatctcgccatcagaattgtcaaaacatcaaagcggcatacctttgcgataagagattctggaaattttcaaacacagttgggtcaactcttgcttctatcccttgaaaccctaatgtaagatgtttggagtgtgtgtcgggctgttttctatttaatgcaaaactttgagccagctcaaacactgtcagatttacactattgagttttaaatgacttcttttaaaaagttagatatattatgcaatattccatctaatattttgaggggaacaaaagaatgcaaatacagtttgatggactttaaaaaaatcattgtaggccgggcatggtggctcacaccagtaatcccagcactttgggatgccaaggtgggaggattgcttgagcccaggagttcaagaccagcctgggcgacatagcaagacctcatctcaaaaaataaaatagaataaaaataaaaatttaaaaaaacattataattctatcctgaaaagataaaaaatcaaacccagcatatcatgagtaattcacctattagacaacttagtacagtgccagtaaaatgggaaactaggtctatactgagataatctaattatagttcatgctttgctttctgatgttgggttgtttcaaaagaaagacattttggcataaaacatccagataattacagttaatctgaatttatcatctttgattttatttgtagataacaacaatgtttacatttgtttagtttctgtaaacctcagtctataaacaaagaagataccttcgagactatccacctgtgaattaaaattatttgctttagcaagactaagcagaagaagaacatagcatatgctgtagaggacgtgtcttgttcctttagtggcatttcttactactggagttttttgcactcaatttatctgggatttagaaaacgtagccttagctgtacatgcttgggaagaaagaaagccttcacattctccatatgtgtaacaaagatgtgtatttcaagcatatagatgcttttctgcaacaaaaaatatatagtctcaatgggttatccagactgcctttatgttcaccaaagtgttaggctgtccaagattaaaattccccaagcccgttaacctcacccgtttttttctgactacagcataagcaactctttcatgacatcactaaataacatacacatgtggtcacagttacagatatatatttcctggctgtatgcaagatgaggcactgtttgcacagtatcctttaagcaaaatgtcaccttccacctgcagacatctgcctacccaaatgcgggtgtgcaagcagtatatgctaagaaaaaatctgttataaactgtcagaagaagaccagacaaactgcagacctcaacagcctaccgcccttaggcagccgtttctacaagaaattatgtgcagattttcctaagcccaagagctgttgtagacaggcatggttctcacacattgcatcattgttccccagttgggaattaactctgtctcaatcccattttaatgtccccagcaggtatatcaatgctctgattcctctctgattatcatcgaatcaccaaattacagtaaacaaaagtcagaccatgcagtgaagagacttctccatccatagcatgttattctttgaaagtagatggttttatttaaaaaataagaatgtacaaaattgtgcatgctagtttttttcagagaacttaaaacacacggttaccctggaggaaatggtcacattctttatttctgtcagtgcctgtcaagattaaacttcctgattggagactagaagataagatcagagcaggaatacaaagaaagagaacacaggctaccagacgtttccaatcacagtaagaaatggcctctggaatggaactcaaattagactaaattccaagaaaaaacctccaccggtcctatctctaatttttttttcacgcacaaaaccatgggatttctcagatctcagtctgtaactgtcttggtcagcttgggcttccataacaaaatacagtatactgagtggcttataaacagcagatatttgtcgctcacagttctggactctggaagtccaagatcaagacatggcagatttagtgtctggtgtggacttccttcctggtacgtagatggcaccttcttgctatgtcctcacatagtggaaggggtgagggagctctctggggtcccttttataagggcactgatttcatttatggggctccacccctatgaccttatcacctccccaaagccccaatttctaatactataaccttgggagttaggataaatttggagaatacatgaacattcagaccatagtagtggcaaaggctatagtcatgtgtcacttcacaacagagatacattctgataactatgtccttaggtgatttcctcatcgtgtgaacatcacagaatgcactttcacaagcctagatggtctagcctactacacacctaggctatatggtctagcctgtggctcctgggccacaaacctgtatagcaggttactgtactgaatactgtagacaattgtaacacaatggtaaatatttctgtatctaaactcatccaaacattaaaatatacagtaaaaatatggtatataaaataaaaaatggtacattagtatagggcagattcattatatctttaaggaatgactgtcatatatgtaatatatatatccaggagttggaggctgcagtgagctatgaatgtgtcactgcactccagcctcggttacagaggaaaatcctgtcgaaaggaaaggaaaagaggagaggagaggaggggaggggaggacaggggaggggaggaaagggtgttaatatcagataatttgacagagagtgggaaaccaggagagaataatttggagtgggaaaaaaagggagagagtagatacaaatgctgtttgcaaaagagcaaatcagacagtttctcctcacagccaactcgtagataaaatagcatccccttgctcttctgggtgtaatgaaaattcccactcagtaggtgttctactattatgacattaggtctggtaaaatgccagtgctgtttgcctgttgccataattaagtagccattgacacttgagtaagaattaataaatagtgcactgtcagcaaatggattgtcaggttcgaaaacccagctgatttacttccaagaaagacaaaccccctactgcagcagagagcctggaattaacaagacttaatctgctaaaggagaaggcagactcccaaaaagggttaacgggaaactgaacacaagtcccactcacatcaggattttccagagcacagactgacctttcacaactccacaataaaaaccagtgacttctgaagagggattctgaatcatatttttccccaaggatttggaaaagtcactttttcatgtgtcatcctcacttgtgggggacatgtgtgtgtgtgtgtggcttcatgattgattgtcttatgcaaactctaattttttacccaggtctaccttggttattctacataggtggtccaattctccatttatttacccctttttctgccatgctgttatcccttaaaattagctttacattttttaaaaaaaaaatgtgtccaaggcatgaaccaggcataggcacagatgaaaagccaagctgggaggaacaaggggttgctttgtccctggctgatatgagatgggcaccaccaactggatgccactctacccaggtcagggaaataaaatgagcttcttaggacaaatcagaaaggcactcaaagacagtcagcgatagggtttggatctgtgttcccaccaaatctcatgtcaaattgtattccccagttttggaggtggggtctggagagaggtgattggatcataggggtgggtccttcaagaatggtttaacaccttctgctcagtgctgttctcatcatagtgagtgagtgatcacgaaatcttttgcttgttcagaagtgtgtagcacctccccacgcctttctctctcttcttcctactccagtcactaagatgcctgctcccccttcaccttccaccatgattgtcagttcctgaggcctccccagaagcagaagctgccatgtttcctgtacagcctgcagaactgtgagccaattcaacctcttttcttcataattatctagtctcaggtatttcttttcagcattgctgaggcaggataggtagtcaagaaaatgactgtgttctttgtgtgcagcaaccatggttaccatgaccatacagtcaacacagtaagcttcagcatttgcactgtcattgaactcattcaagcaaaacaattcttcagtaggaactttcccttacagagagcatgcgcattttgatgttaccagtcctcaaactgaccctttgctcattttaatagtaaaaagcacacctgcgggtagagatataagatgttaatgagacctgcaatgcatgaaaaagcacgtacagctactgctcatgtgcacccagaggaccacccagaacatgcttaacagcaacacctctttccacctccttataaatcatcatgtaagactcccataaagggagtttctccagcaataatcaatactctgtcaccctaactagctgcctgccctgaatctactttctcaggttgtactctctagtctcccgctgactttcaaaatactctttttgttttgcaataatttactctatgctgcatctccttggctgtgtgtctgtgtttaaattcttttaaactaggaagacaagaatcaaggtatcacgacagccgtcaacaatgtgagaacggactaatatgaacagaaaatgaggaaaacagctatcaggtagcaggacgagaaagtctctgatttcatcctgcaaacaacctgtaccacaccaggctcacaggccctcctatatccttcaagctcacagggacccccaccatccttccatgccgacaatatcccacgtgttctcccaagctcaaagtggcttccacatctttctaagctctcactcactcgcagtccatgtcctccaaatcatatttctcacaagattccacaactttcttttcctgcctcttccctacaggcagaggttagaatcagcctctctggtcagcctcatctgaactcctttttctgtcttttctttccattcgttcataatcagtgctttgattaacatctccacacttggacaccctgggtgaaatgtgctccctgtggggctctgacggataccccatcttcattcattcatttctataaagcaacttgaggcttgcaaccctgttcactgttcaatttgcctttttaaacccagcctcatattccaccatcctacagaaacccccatggctccacagtctcccaaaagtaaatttagggggaaaatagcctatgatatacaacttgtaaaattttgtctgttgatttcacctttctgatttggctgaagtttcacaatgcagggatatcatcatcactcttccaacaggaagaaatctttttcttcaattcccagcaaactgaggaactagaagatgagtagcactggcactcaaaatatttagacacatatgagggcatttcttgcccaaaatgacagcttaactttactgctactgtttactgtaatcttaggaggcttgtgaatttttctgaccctccagcaaaggtgaagatcagtcatccataactgatgtcgtaaagcagatggcatgaagcagacatctgcagtggtaatggaacaggaagcttacactcttcctagcttggaaacaatgctcaaaaagggtacctggtaaagacaaagagttaacactgggaagtgtgctggggaaatgctaattttctcacactttccatgctcatgctcagtccctggggcagcgtgaccaagagctctaggaagagaaggagaatctcttttcatttacccctgactccaaacatgcatgcaaacagatgggtgcatcagtagaataagttcacattcatctaccaaagggttcaataaactaagaattacatgatcctatttggggttaaaacatagaaattttggtttcttccaataataacaactttgcactagtagttcactatctagagcaaataaactagagaagcatggtgactatgaaataaaaatcacaactgagtaagacttttagaaaggagacagtatgtattcactgacagccacatatttcagcaagatgcaccaggtagttgttcttgagagaattaataacagatgaatctcaggttcagaaaaggcaaaagtaaaaacaacaaaactgaaagctacagacaacttggaacaagaatgttccaaaaaaaatctggcttcaagatgctcaggaactagattccttccttttatctcttctaccaccctaatacatgactttcatcttcaagtttgcctcatgtctcagtgtgaatgctgaagctccagccattgtatctacatcccagaaagcagatgagggagcagtgaggaacaaaatggcctctgcgccaagtgaattagctctttctctgcagtcttcctaaatgtcccacgacatttctactgcaatcctattgaacttagttacttggccccaactagttgaatgagaggctagcaactatagtttgctcgttaagtttggaacattaccacctcaaaacaaatttgaattcacttgagaaaggacttcagggcaggcttgtaatcccaacactttgggaggctgaagcgggaggatcacttgaggccaggagttcaagatcagcctgggcaacatggcaaaaccctgtctctacaaaaactacaaaaaaattagctgggtgtggtggcaggtacctgtagacccagctacttgggaggctgaggcaggagaatcacttgagcccaggagacggagcttgcagtgagccaagattgcgccactgcacttcagcctgggcgatgagagtgaaactgtgtctaaaaaaaaaaagagagagcgagcgagcgagcgagcgagagaatggacttcagttatcaaatgccagtttctgctccaaatgccatggaataaccgacttgatgagagcttagagatgacagcttagagattggtcaaggaagatttgtgagccacgaacaccagcttctagaaaagcagtgcacactcctctgcaggctcactcccaagcaagccaattgttcactgtggagtttgggtctcctgtcccttgctcccttctcctcacacatccccagtcaccctggaggtcagaatctaaaatgggtcagcagggctgctgtctttgggaggctccagggaaatcgtttcttgcttttttctgacttctagaggctgcctgcattccttggctcatggctccttcctctgtcttcaaaaccaggagtgttgcttcacttcccccttctctgtctgtctctgcctctctcttctctatctctccttgtgcctctgtctgtctcagcctctctctgtctctctttctgcctctgcctctgtctccctctctctgcctttctgtctcccattctctgtctctctttctctctgtctctctttccctgtgtctctttgtctcttcctgtctctctgtctctgtctctctctgtctttgtgtttttccaactctcgttgtctctctctgtctctgtgtctctgtctctctctctttgtgtgtgtgtgtgtgtgtgtgtgtgtgtgtgtgtgtctctgtgtgtccctctctgtctctgtctgtctttccttctctttctctgtctctctgtctctgtctgtctctctctgctttcttcatcgcatgtcttcgactccttgctgctgccctcttccaaggagcttggtgttacactgagctcatctgaataatccagaataatctcccctctcaagagccttaatctggaaagtcctgtttgccatgtaatgtaaaagattcacaggtttctgagatcaggacatgaacatctagggacaggggagacccacgttgcagcccatggcaaccactttaggattctcaataaaataatagagtcagccaggcccagtggctcacacctgtagtcccagctattcaggaggttgaagtgggaggattgcttaagcccgggagtgagctacgactgcaccactgcacttcagccagggcgacagagcaagaccctgtctcaaaataaacacattaattaattatatagaacagaatttgtttttctaaaaggtatttactgttttgatgactgttatctgaatgtttcaggtaatggattttatttatttatttatttatttatttatttatttgtttgtttatagagctgggttcttgctttgttgtccaggctggagtgcagtggtgcagtcatagttcattgcagcagtgacttcctaggctcaagtgatcctcccacctcagcatccggaagagctgggacaaccggtgtgcactaccacaccctgcttatttttcaaaacattttagtagagatgaggtctgattatgttgctcaggctggtctagaactcctgtgctcatgtggtccttccacctcaacctcccaacgtgctgggattacaagtgtgagccactgcacctggccatgctgattttaaagcctatttaaatcttaaagcattacattgtcctccatttgatggcataataatatttgtgaccatgttcatatgacagtgcttaaacatgttgagtgttcagagaaagaaccactgttgcagactgactgatgtttagaatgccttgtggacaaaaatattacaaagaagaaagaagtagttttctttagccctcagaagactacttggtgaataaaccagtgacatttcactttaaagaaaaaattaagcaggtagggtttgcttcaaagtaaatgtgtgctgagcataggagaataagaagtggagaaaccttgtatacatggaaagggtaaagttaactcttggaatgtggctaaaattcaaggtaaggaacacagcaagttgtcagagtcataacatgaataattaaggtaacacagatagaattttacaaattcagtttgcaaaataaatatccaaagaatgactgaataattagtaagatctatagtttagcatttaacaaaaaggattcacttcggatgctgatctgtgagccaatctgtgtctatttccattcctctttacagcacagctgtcatatattcgctataatatgatagatatgccaggcatggtggctcacacctggaatcccagcactttgggaggctgaggcgggcggatcaccagagatcaggagttcaagaccagcctggccaacatggcgaaaccccgtctctcctaaaaatacaaaaaataatataagcagccgcttttccctggcacatggggtctcctctcttggctttggagccccctccctctgtctctgcacaggggagcttcttccatctttcttctcccttctttctttctattaaactctccgctccttaaagccaaaaaaaaaaaagatttaaaaaatacacatacaactacaaaaaatagccaggtgtggtgacgcacgcctgtaatcccagctaatcgggaggctgaggcaggataattgcttgaacttgagaggtggaggttgcagtaaactgagatcgtgccactgcactccagcctcggtgacagagtgagactccatctaaaaaaaaaaaaagaaagaaaaaagaaaaaaaagaataatatgatagaaagatagataataaaatagtagattaacagacgatacatgataggtaaggtaagtagatagatgatagataaaatgataggttaataggtaatagaataatacaataacagatgatagagatgatatgtagacaatacataaaatgattgataggtgacagacatgatagctagatagatgactgacagaaagataatagatgactgcctgacagatagatgataaacaaatagatgacaggtagatagatatgataggaagatgataaatgatagtcaatagatagatatgatagatgataacgatagctagatgatagatagatgatagataaatgcatatgatagatatgatagaaagatgatagataatatagagagatgatagatagatagatagatagatagatagatagatagatcaatagatagtacatacatactttcatttctatggctactttttaaataaatgcctaatgttttatatgttgacatataaaagcgtgtgttcagcccaacttccattgtgaaaaacagcatgtgaaatctaacaccactcaaagaatttggtgcattttcttggctgtagtgctggtcaagtttggcctcaactgcctagagtgagcagcagaatcagggtaggcggccggagcagtgtagagccccatcaccccactcaacaatgacacaaacatgaagtgagggctggactcgggagataagaggttggatacagtggacaggtcaccaagattcagagtctaccatgaaaatcagacagtggggcttatagtggaatggagagagcaggacctaggaccagggtggtgactcagtgggtccacatgaatactcattgatggtagttagtaaagaggggacatttttgtggagtcaagatccaagccgtgggaactctgtcatctggtcccagaaactgagacctaaaaaggcttttatctatgaagaattttgacaaaggcatacttacttacctgaacaagacaacagtgtcaaaatatagaagatgaggggcaaaaagagagaacaaggcactgggtttccccaatatcttcaagggacattactaagctcttaagatgaaacacatcccataacccgcaccatcaccaggagatgggcactattctcatcttcatcttaacaaataagacaatggaagttcagagagattagagaatttggccaggtttccacaagcaataagcagaaacaccattgcttgtaagaacctgatctataatagtgcaaaggcagtctaacacttatttacagttcaaaggattgtaacaagtagatttttttttctgtgttacccccaccccccttaatattttcattagccagcatttaaattataagcagaggtcgggtgcagtggctcacgcttgtaatctcagcactctgggaggccgtggtgggtggatcacttgaggtcaggagttcgagaccagcctggccaacatgatgaaaccccatctctactaaaaatacaaacattagccaggtgtggtgacgcatccctgtagtcccagctactcgggaggctgagacaggagaattgcttgaacctgggaagtggaggttgcagtgaactgagatcgtaccactgcactgtagcctgggcaacagagccagactccatctcaaaaaaataaaaataataaaaaataaattataagcagaatttccattgcattttgcttatctgatgttcacatcttgggtataagaacactcatattcaagagctaaataaagttagactcatattcaagagctaactaaagttagacacaattacagacattaacactatgaagttctaggaagggaaacactagaaataagaggggtgtaactaaaagcaaatcaagccatctgttttcatctaagtacgttctattcttcattgtttggtttttgcaatcacatgacaatattccagtgcacacactgaatgtctctctcctctctcgtaggcaacaagaatggacaaggcttcttaagctactcaacttcaaactatgcacaagtgaattttaaagacacacagagctattttaccggcacagacttggagttgtgtcctggtaacgtctacacatctcggccaatgcaaacacatctcaggtgtggcaaaaaccaggtgcagccaagtgtctctacccttcggagaattggctcacgaaaaatgtccacacaccaattccatgaaaagttcataaagtatcatttaaagtaacaatgttcagcacatgttttaaaagttgcgaaggaaatagagataaaatagaaatggacagaacttgatgaaaacataaagtcagtttggactgctctcagaaaaggagaacacactatatttttatttaatagctggagtttgggaaccatctgaaactctggaaccactgcctccattttccactcccctcagccaggctagaaacagcattgattataaaaggtagtgaacacgattgcaccaagaaaaatacgtccattgtagcagctactgggttaaggcagaatggaaaaatcagagccatcccattctcctaagccagattcccaagtgcggaggaaaggaggggtgggggcagggactgagatttccaagcagagttaacttctggtcctcatttgagctggaatggagggacttaatacttcgaatctctgagacattgtctttttccaacccaacagcactggattccacaagttattctaaggatggctctatggccaaataagcaaagaaagcagaaagcagcacaatgtctggggtatggacaagatgcctgcattatgcttgggccaccataacaaaggtccacagaccgggtggcttaaataacagacatttaccctcccacaatcctggaggctggaagtccgaaatcaaagtgtgggcagcgctggttcctcctgaggcctctctctttggcttctagacatcgtcttttcccttttcctcatgttattgttcctctgtgtgtgtctgtgccatctcctgttcttataaggattccagtcctgttggatcaaggaccaccctactgaccttattttaccttcgtcacctctttaaagaccccatctccaaatatagtcacattctgaggtcctggaggttaggatttcaacatgtggatttgaggaggatacagttcagcccaccacagtgcctcttcctgacaaagcatgtttcatgctgaaatggtatgcacaagccactagcagctgcttggcatatgttgatggagagagaagaaattcaggcaatagcagtaaacatcagagcacatagcaagagagagcatcgcccttggaccatgttttaaaatttgttttttatcctctaaatcagagattgacaaactagggtccactggccaaacttggcccatcatctgtttttgtaaataaagttttatcggcacacagccacatccattcatttacatattttctgtggctgtattttcaacccaatggcagagttgagtagatgctatggagaccagatgatccactaggccaaagatacttagccagtttaaaaacaaacaaacaaacaaaaaaccggtatgccaattcctgctctaaatgatgggacgtgattagaaagaattttatttaagagcatggcacactcacatttataattttgtaattacccaagcaatcctgtagggattgaactagaaggaagtgccagatggaagaagacctcaagggagacggggcacagggatgtaagataggaattcgtgtgtgagataatcgtggaaggctgaaatttcctttaagacctagatagtaagttcttcagggaaagaaaattgcggggcagagaggaggcaaaaatgacttgcaaaggtttgcagcccctgatcggacatgtgggcaagaacttttcatgggtgcagagactatttctaggcagcttacagacctggcagggtgaggcaccaccattgatcagtgtattagtctgttctcatgatgctaataaagatatgcccaagactgggtaatttataaaggaaagaggcttaattgactcacagttccacatggctggggaggtctcacaatcatggcagaaggtgaatgaggagcaaagtcacatcttacatggtggcagacaagagagcatgtgcaggggaattcccctttataaaaccatcagatctcatgagacttattcactatcaccaaaacagtaagggaaagacccaccccccatgattcaattacttcccaccgggtccctcccacaatacattggaattatgggagctacaattcaagatttgggaggggacacagccaaaccgtatcaatcagtaagtgattgatcagagcccaggggtagtctcaagaggatgtggtttgcagagttgatccaggctggcagcctgagggctggtactggcctgaggcatcaaagaaaagaagaaagtcaggtggagctagtagactaagatcaaagagatggggaaggattatgagggtcttggggagagagggctaaagctaaagtattatggtcagatgctgactgctatgaaatgtaagatttcagagataatacagatgttgtggtgataagaaggaccagggtgaagacatgacagctgtctgttttttaagctatttgagtgaggttacaagatcactgccggggaggaattcagcattgggacattcatgtccagctgggaagtgacttttgtgttcattatatctggacacagatgtagcaatggagtcttcccagtctgtgaaatggtagaatcctaggtcttgggtccatgatgtaacctacaaattgcatctccatgtggttgggcatgaatgagaacctgtttctgatttgtgacttctatttttatggtattcaaagttccaagtttcttctcaaccttataattattcatagctcagggattatctatggcactggagcagatctcatctccaagtccaagattatggggattggctcaccccagggggatggaattagaagtgacttccccgcctcctcacctaagattaaaaaaaaaaaatgagtcctattggctcactcctgtagtcccagcacttctggaggccgagatgggaggattccttaagcccaggagtttgagactagcctgggcaac[137 bp omitted]ggtgaaatcccgtctctactaaaaatacaaaaaattagctgggcgtggtgacaggtgcctgtagtcccagctactcgggaggctgaggcaggagaatggcatgaatccgggagacagagcttgcagtgagccaagatcgcgccactgcactccagcccgggctacagaacgacactccgtctctctctctctctctctctctctctatatatatatatatatatatatattaattacccgagcatgtggtggcacatgtctgtggtcccagctactcaggaggctgagatgggaggatcctttgagcccaggaggtcaagtttgcagtgaattgtgattacaccactgcattctagcctgggcaacagagtgagaccctgtctcaaaaaacaatgaactagaaattctacatagtaataatttttttgtgcataccaagacatagacaggcatcttcactcgatttccccatcattctagccatctccaaacactcaccccaaaaatccagtacctagtggccagcagcaggattcatgtccagtgcagggatttaggattctgtgtggtaggtcatgtagaccccactgtacccaatgaagtggccaacgctgccttggggtggcgaagctttaaatcatcccctgtggggttacactgttctcatcagtagggacgtttgtccaccatgttgacctctgcctcctcggttggtcctgacagatgctgtgatggtcttactattgaccagggatgtaaatgagatacaggaagtctgcggtcaactgaagcttcagttttggtcactgtcccaggaggatcccatggaaacagacaaaggagagaatgagcacaggttggccataggactgtccgcgcagcagggtgaggatggcaggagaaggtcccacagggagcagaagaccctttcccatgttatttgggaccacagaagtctgtgattctgcagacactttgttggtggcactttcttatggcaaccctagtgttgtggtttgaatgtctgtgtcctcccgaaattcatgtgttaagccctaaccttcaaggtgatgatggtggaaggtggggcctttgggaggtgatgaggtcatgagggtggagactcacaaat[133 bp omitted]gaaaccccatctctaccaaaactacaaaaaattagccaggcatggtggcacatacctgtggtcctagatacttggaaagctgaagtgggaggatcgcttgggtccggaaggcagaggttgcagtgagctgagatcgagccactgcactccagcctgggtgacagagcaagaccctgtctaaaaataaaaaagaaaaaaaaaattaaaaaagataggagacaccatggttcatgcctataatcccagcattttgagaggtcaaggtgagaggattgttggaggccaaaagctcaagatcagcctgggcaacacagcaagaccatgtatctacaaagacatttaaaaattagctgggcatggtgacatacacctgtagtcccagctacttaggaggggctgaggtgggaggattgcttgagccccagagttcgaggctgcagtgagctatcatcatgccactgcactccagcctgggtgacagagtgagactccgtctgaaaaaattaaaaataaaaaaattaaaataaccattttcatgtttttatagcaaacttaaatatacatataaatatatgtactcaatatgcacttttaaattttagtgaaataagcttttgtgtaccttatctgaaaaaaaccaacatttcttcctaaactcttctctcctgaaaaacaacagtagtaaagataataagtagcatgtttgctaattgaaaaaactagcacagcagccagaaggaagaacagcaatgttgatgtttaaaggaggactacaattttaagcacgagcttgtggtcagtttatttgcattgtttggcttttccactcaacatgttccagaaggttctagatttatattgaagaagagttttataagttggacagtgatgttatttgttttcgaaaagcagtgacactgatggccttagaggctaggtaccttagaaaggatatattttcatgtgcatagaaagattcctccctccctcccttccttccttcactaaaagccatccttagctcaaggagagggagtgcttccttgctaacagccttgcaagacacgggattctccaggcaggacgaggagctgaacatttccagaaacctggtcagatggttctgcattcttctaaaagatttgctgagacacatccacttgctgccctcatggcaaaagatcgcatagatcttgttgccatcttctgtgtctcagcgaaatagccctgagcaaaatcgcacattaaatcttctggttgcagagttaactcatctgttctcaaacaacctggcttacagaagtggatgccaatccaaagcatgcccagagggcacatgggtattctttaatgagccaactttcattacataagacactcaattgtgatcattggtgaatttatcaagttggcagggcatgtttccacacagtcatcctttttattcttcagacatctttactctttcatcagcccagagaaacaaatgtttagagacgatgatattttctcaatgtgtactgcagtttactatgcagaacccctaacatagacaccagctctcatggcctgaatgctttgattactgtagatgatcaattcagaggtattattagatctcagagtgaattgatttttggttttttttggaagatgggaaaggtggagttcaccaagagtcactctgctcattccaagaccctcaactctccatgaagttcttcatttttgtctcaagtaattcttttaagtatatgtgctcacccaataaaaatctctgtcttggtgaaattgtggaggtgtaaagtcagacagagagagaaactcttgttgccttctttaaaggataaacatgcctttttctgatcaaacttgagaccctccaaaattaaactagctgttaagtgtgtgaccccaaaaggaaaggaaaaggtaaaaggaaggaaggaaggaaggaaaagagggagggagggagggaaggaaggaaggaaggaaggaaggaaggaaggaaggaaggaaaagagggaggcagggagggagggaaggaaggaaggaaggaaggtaggaaggaaaagagggatgcagggagggagggaaggaaggaaggaaggaagggatctttctatgcacatgaagatgtatcatttctaaggtacccagcctctaaggccatcattgtcactgaaatgttgttgttgctgttgtttgtttttgagagagtttcactctgttgcacaatcacagcttcactgcagcctcaaactcctgggctcaagcaatccttctacctcagcctcccaagtagctgggaccacaggcgcatgccaccatgcccagctaatttaaaaaaaaaaaatttagagatgggtctcactacgttgctcaggctggagattattttttaaaccaaaaaatatgagaaatccttagccccctacttccatttgtattttgcttctatctaaaaagtacccaagttgtttaatttcacaacctgaaagcactggaaagctttagattggaaatgcaggatttcactttatgcgatgggactagaccatcacaagatctagtggtgacttgaattttgatgccacagataatcctctttgttcaaagtgccctgtttagaaattcatacatcaggcaatgcagcccttacaatatgttttcattgtgatattgaggaagaaaagatacaggaagggagaaaggaaaagatgcaaaaaatgaggaaaacattacatactttataaaatataagaaccataggctgggtgtggtggctcacacctgtactcttagcactttgggaggccaaggcaggaggattgcttgagcccaacagttcgagaccatcctgggcaacatagcaagactctatctctaatttttttcataaaaaataaaataaaaaataaaaaagaactatgaaaagaagggttttttttgccctcaggaaacttgcaatctaaattttcttctaaacccggatttgctttaaatgacttgtctaaataaacttatctttccatgtcattttttatcttgtttttttagttgttgtttgcttactaaacctaagcctgggggccaggagtggtggctcacacctgtaatcccagcacgttgggaggccaaggcaggcggatcacttgaggtcaggagtttgagaccagcctgggcaacatggtgaaaccctgtctctactaaaaatacaaaaattagctgggtgtggtggtgagtgcctataatcccagctactggggagattgggcaggagaatcacttgaacctgggaggcggaggttgcagtgagccgagctcgcgccactgcactccagcctggcaacaaagtgagaccctgtctcaaaaataaataaatgaagaacctaagccttgaagaaataaatcttttaaaatttcattatgattttacttttgctaccaacaacaccagccttctctaaaaatctaacttttgcttgtcaacactcaaaaacaacattggtggaagccaaatgtacctcaaaagatgaatttcatgcttttttagaggaaaaagcctcatgaactgtgctaggtattttgatgatcagctcttcgcatggacatcttgtcatgaatatttattcataggacattttcttttcttttttaaaggctaattgatattttcatctgagccaaacagtaaatgtggcatagggaaagttgtgtctcactattggattcctgagttagtgaaagaaaagagcttgtatcttctaaaagtggaggtgaattatgtttattctataaaatacataataaatatcaataataatagatacataagagtcataattctctatgggaagttatttctatagcggagtaagaaaaatctactgaacctccctctctgccaccacaaataaacttccacgtccccagggaaaaccttgttaagtggtatacactgccctcttgtgcagactgtttaaacagaaaagatctcacgcacctattacataaaacattttttaaagctctgcataaaggaggaagacaactaaatctgccaaggtttcttgttgatttattatagctgtttcataatccacaaagccatagtcagcaatacccgcaaacattctgtatacaaacgactagctaggtttacagttcaaatgagtataaactaaattgtttctgtttccaagaattaagcaaccatggattttttttaaatgttccaattcgcaatgttcaaatctatgtggtacacttatcttttaagcgttttgcaagatgcaccagcaccacgtataatatgattcgccagccacaaaagaaccagtcatgcctgagatttctagaaaattttacaatggttaaaaatgtctccactggggcgtttgtgttggttttcctgaaaggcatgggatggtcgtgcagccgattctcataacgtcgggattgctttctctctctctctctctctctctctctcgtctccgtctgcaaaacaatggagcagggttttcctggcttcttctgcttagcgccacttttcttttctttttaattcccaggtccacaaacaatttttagagctaaaagaaaaggtatgtggcaatacttaattgctggacccatgaagccaggaggatctgagactcactccgagagccagggactttccaatgcgttgggaagcagcctctgcaggaagctcggcatgggaaaaagctgtaccggctgcaaatcgtcccttctggttccggcgagtgacagcagagggtgacacagatgctcacattgtcagtggtccttgctgtgttcatctgaccctgcggtgctccacacaggcaactatgtccccagggacactcgacaatgtctggagatagctttgggtgtcgcaaccggggtggttggtgctccgggcatctggtgggtggaacccagggacactgctcaacaccctgcagtgcacaggacaccccaccccagaggatcatccacccagccttaaatgtccacactttgagaaggactgtactagaggattgatctgtagcattctaatccttatcagaatcccaacctccatggtgtcaagggagaaaaacgtgtgtctctattcacgagagaaagaaaagctgagtatcaggcaggactggggtgtgcggaagcaggtgaagtggagcttcagaagagtggccccatgggcttttgaggggacttctctgttgggtcgtctaaatcttcatcccaaactccccagtcaatatgtggtggattcgtgtgaaacaaaaagagaccaatcgatttatcttcatcacctaagaggccattcattatgaagtaggagacccaacttgactccggaggcagggacttagactttggaccacactgaagactagctaaaatagggaagtggcaatagcaatagctcctctccataagacacgcccaccagtgccatgtcagtttactgttaccatagcaacacctggaagttaccgcccctttctgtggcaatgatccaagaacatggaagttactactctttttcttgaaatctctgcataatctgccccttaatttgcatgccattagaagtgggtatacatatgactccagcactgcctctgagctgctgttctggacgcactgcctattgggtagccctgctctgccaggagcaggacctctgctgctgctgctgtgcactgccacttcagtgaaagtgggggtggctcacgcctgtaatcccaggactttgggaggctgaggtgggtggatcacttgaggtcaggagttcgagaccagcttggtcaacatggtgaaatcccatctctactaaaaatacaaaaattagccaggtgtggtcatgtgcacctgtagtcccagctaccaggaggctgaggcaggagaatcacttgaaccctggaggtggaggttgcagtgagccgagatcacgccactgctctgcaagttgctgtctaacaccacgggctcaccctgaaatgttttcctgggtgaagccaagaaccctcccaagctaagcccccagtttgggggctcacctgccctgcaacaattagacaaccacagtctgaatcaaggactctctgaatgggataacacataggttcctacgacagcgaggaaacttctagaattgcctggggctaagggtttccccaggatgtgggaccttcagctttaaaaccacaaaagtcctgggcaaactgtaacagacagccaataagcacagttattctccagcctggctccagaggtcttcgctaggcagcaatttaatttttaatatggaaaatatggctaaaacttatttttatagtattttaggaaacagggcatcattatctcacattgcaaatttaaatcccaatagatattagaccttcaaaaaataagaataaggagaatttgcttaaaattgcaaatagaggaatgctgtcatgaacttcctactttgtatctgtcataattctgaatctaaatcacaattagcctgcaactgacactgtaatagtcaccaaaatttgcaatacctgcacagagtatagtcaaagaatttcaaccaaatcctttctgttgatccaacaaaataaaatgtatacagatatgaagggcattggagaatggtgaacaagtatacttggcgtggctggagcagtggctcacatctttaatcccagccctttgggaagttgaggtaggaggattacttgaacctaggagttcgagacaagcctgggcgacagagcaagaccctatctctaaaaatattttaaaaattagccaagcctggtggtatctacctgcagtcccagctacgcagggggcttaggtaagaggatcgcttgaactcaggaggtgggggctgcagtgagctatgactgcaccaatgcactccagcttgggtgacagagtgagaaccccgtctctaaaaaaaataaacttaggaaaataaaataaataataaaaaatgcactccagcttgggtgacagaatgagaccctgtctctaaaaaaataaaattaggaagataaaattaaatttaaaaataaaaaagatacttggtgaatttctcctccacaggggagctggctcccagaaggaaagaaaggccatccacattctacagatgaacaagttcactcctcactgaatcctgtgcattagcttctcagatcatcgcaggatctccttgactggaaagtcagaaacaaccgtggccataactaccaccatcaaaaccaggaatacactccttgcatttaggattagatgcaggttttgtgggagctgaagcttacaaaatttcagaagtcatctttcagaaaatgaatttgaatgtatcttactttgggggattttacaaaactgtacaaccatgtgcaatgaactgaatgcttgtgtctcccacaattcctatgctgaaatcctcacccccaagatgatggtgtcagggggtgaggcccttgggaggtgatgaggtcatgaggatggagcctcctgaatgggatagatgagagatcaatatatacatagacacagttaggaggagatgtcacttaataacatgcaaaagtatcaaaatacaattgcaaatatataatattcataaaataaaacatatatacttacttttaaaaaaatacactatgattaaactagtcataaaatcaacaacattctaaatgtctaactagtcataaagttacctgttataacttttgtcattattgcatatcagagtttcccaatcttggcactattgatatttgaaccaagtaattctttattatgggaagcagcctgtgcattgtagggtgttaagcagcatccctggcctctactcaccacatgccagtagtactctccccaggtgtattaaccaaaagtacaagcagacattgctgaatgccccctggggtttgggtatggagttcagaatcaccccaactgacaaccactgacatagacctgtgacttcatttccttaccatctgtgattcagtttctcatagtgtgtgatggtgaatttcatatgtccacttggctagtgtgatggtgaattttatgcgtccacttgactggcgtgatgatgaattttatgtatccaccgggctggtgtgatggtgaattttatccacagtgcccagacgtgtggtcaaaggttaccctggatgttactgtgtgggtgtttttggatgagatgaacatttctttcatgcgcgtccatgtgaagagaccaccaaacaggctttgtgtgagcaacagggctgtttatttcacctgggtgcaggcgggctgagtctgaaaagagagtcagcgaagggagatgggggtggggccgttttataggatttgggaaggtaatggaaaattacagtcaaagggggctgttctctggtgggcaggggcgggggtcacaaggtgctcagtgggggagcttctgagccaggagaaggaaattcacagggttaatcactcagttaagctggggcaggaacaaatcaccatggtggaatgtcatcagttaaggcggggcagggccttttcacttcttttgtggatcttcagttacttcaggccatctgggtgtatatgtgcaagtcacaggggatgcgatggcctggcctgggctcagaggcctgacattcctgccttcttatattaataagaaaaataaaatagtgttgaagtgttggggcagtgaaaatttttggggggtggtatggagagagaatggacgatgtttctcagggctgcttcgagcgggattaggggcggcgtgggaacctagagtgggagagattaagctgaagggaggtcttgtggtaaggggtgatatcgtggggatgttagaagaaacatttgtcgtatagaatgattggtgatggcctggatacggttttgtatgaattgaaaaactaaatggaataaaagaaggagaaaaacaggtataaaaggtctaagaattgggaggacctaggacatctgattagagagtgcctaaggagattcagcatagtcctgccagcaaagattatttatttacttcaagagttaagagtggcagtttggggatagcacgaggagatatcagctgtgatggcttggagaaacagtgtaaaccggcagtgtaaacaagagcagggcatgtatgagtagttgagaacggtgaataggagtatgactagacagaagatagtagggatgacaagttttttggggggcacagtctaagttggtccggtgtctggaatgagactggggcctaataaaaggagtgtctatacaggagcttaaatgggctgtaccctgtagcattctgaggacaggcctgatttctgagaagggaaagtgataaaagtattgtccagtcctttttggtggctgagcttggtgaggtgtgtttttaaaagacctttagtctgctctacttttcttgaagatagaggactataagggatataaaggtttcactgaatactaagagcctgaaaaactgcttggtgatttgactaataaaggctggtctgttatcagacggtatagaggtgggaaggctaaactgaggaattatgtctgacagaagggaagaaatgactgcggtggccttctcagaccctgtaggaaaggcctctacctatccagtgaaagtgtctatctagattaagaggtattttagtttttgtgactcagggcatgttgagtaaagctaatttgccagtcctgggtgggggcaaatcctggagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctggtgtgtggcgattaggcctggtggaaccgccatcaataaatcaagcgtgatcagggtgaggaacaggaaagaaggaaatttggggaaatggggtgaatgtcaggtggatcagagagatacagtcatgggggtcaggtgtggtatcaggaataatgtgggaggccggattgaagtccgggccaggaacaatggtaattgtgggagactcaacaaagagtgagtacagctgaaggagccgggaagcagaaagtatatgcatcaggtatgaggaagaaaatagattttggaagttatgagaagtgtagagagtgagttgagcatagtttgtgattttgagggcctctaacagtattaaagcagcggcagctgctgcaggcagacatgatggctaggctaaaacaggaaggtcaagttgtttggacagaaaggctacagggtgcagtcctggctcttgtgtaagaattctgaccacgctaaccatgcctaggaaggaaaggagttgttgttttgtaagggattgaggtttgggagattaatcggacacgatcagcagggagagcacgtgtgtttttatgagaattatgcctagataggtaacagatgaggatgaaatttgggcttgactgaagtaatgggggccgtctgtgaagccttgcggcagtacagcccaggtaatttgctgagcctaatgggtgtcagggtcagtctaagtgaaggcaaagagaggttgggatgaagggtgcaaaggaatagtaaagaaagcatgtttgagatccagaacagaataatgggttgtagagggaggtattgaggataggagagtatatgggtttggcaccacggggtggataggcaaaacatttggttgataaggcgcagattctgaactaacttgtaaggcttgtctggttttaggacaggtaaaatgggggaatggtaaggagagtttataggttttagaagcccatgctgtagcaggcgagtgataacaggctttaatccttttaaagcatggtgtgggatgagatattggcgttgagcggggtaagggtgactaggttttaatgagatggtaaggcgtgcttgatcggtcgccaaggagggagtagaggtatcttatacttgtgggttaaggtgggggatacaagaggaggacgcaaaggaggctctggattgggaagaagggcggcaatgagatgcaggtgtaatccaggaatagtcagggaagcagataatttggttaaaatatctcggcctaataagggaactgggcaggtggggataactaaaaaggagtgcgtaaaagagtattgtctaagttggcaccagagtgggggagttttaagaggtttaaaagcctggccgtcaatacccacaacagttatggaggcgagggaaacaggcccttgaaaagtaggtaatgtggagtgggtagcctccatattgattaagaaggggacggacttaccttccactgtgagagttacctgaagctcggcgtccatgatggtctacggggcttctgaggcgatcaggcagcgtcagtcttcagccgctaagccgagaaggagtcagtcagagagccttgggccagagttccaggggctctgggagtcgctgccaggtgagttgaacagtccgatttccagtggggtcccgcacagatgggacacggcttaggaggaatcctgggctgcaggcattccttggcctggtggccagatttctggcacttgtagcaagctcctgggggaggaggttctggaggaatgcctggccgctgcggttcaggcgtttggaagttcttgtgtgctggagatgtggctggggtttgtttcacagtggaggcaaggaattgcaacttttttttttattattgtacaccttgaaggtgaggttaattaagtcctgttgtggggtttgagggccagattctaattttgggagttttatttaatgtcgggagcagattgggtaataaaatgtatatattgagaataagatggccttttgaccttttagggtctagggctgtaaagcatctcagggttgctgccgaacgagccatgaactgggctgggtttttatatttgatgaaaaagaacctaaacgcttctgatttgggataaagaaaaaggagcattaaccttgactatgcctttggctccagccacctttttaagagtaaattgctgggcaggtgggggagggctagtcacggaacgaaactgtaagctggaccaggtgtgaggaggggaggcgataaaaagattatagggtggaggagtggaggctgaggaagaatcgggacctagcttggcgtggtgaggaggggagaggtcagatgggtctgtagaaaaggaagattacaaagactcggcgacgcttggggttgggaatgaggggacaggtgggaggggaaagaaggaagatttgggatgagttgcactgggcacagagactaggaagggactgatgtgtaaaagaatgcctggacatcaggcacctcagaccatttgcccattttacgacaagaattatttagctcttgtaggatggaaaaattgaaagtgccgttttccggctatttggagctactgtcgagtttgtattggggtcaagcggcattgcagaagaaaataagatgcttagattttaggtcaggtgagagttgaagaggttttaagttcttaagaacacaggcccaccaacagtgtaaaagtgttcctatttctccacatcctctccagcacctgttgtttcctgactttttaatgattgccattctaactggtgtgagatggtatctcattgtggttttgatttgcatttctctgacggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgagttcaaccattgtggaagtcagtgtggcgattcctcagggatctagaactggaaataccatttgacccagccatcccattactgggtatatacccaaaggactataaataatgctgctataaagacacatgcacacgtatgtttattgcggcattattcacaatagcaaagacttggaaccaaaccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcattcataggtgggaattgaacaatgagatcacatggacacaggaaggggaatatcacactctggggactgttgtggggtggggggaggggggagggatagcattggggatatacctaatgctagatgacgagttagtgggtgcagtgcaccagcatggcacatgtatacatatgtaactaacctgcacaatgtgcacatgtaccctaaaacttaaagtataataaaaaaaataataaataaaaggtttaaaaaaaaaaagaacacaggctaagggagaaggaggaatggaaggtggaagcttgcccatagtgaaggaggcaagcccagagaaaagagtagagacacggagaaggggtgggggtttcttgccctccagaaaagcagagaaggggtcagggcgcagagatatgaggtcggggcatggaaataagggatcggggcacagagatatgaggttggggtacttgcccctcctccagaaaaacagagaaggggtagagacacggagagaaggggttggggtacttgcccctcccctagaaaagcaggacttgctgctgaggggaaggagaaggggttgaggggttcttgcccttgccccagaaaatcagagaaggggtagagacacggagagaaggggttggggtacttgccccttccccagaaaagtgggacttgccactaagggtgaaggagaaggggttgaggcatacttgcccctccctcagaaaagcagagaaggggtagagacacggagagaaggggttggggtacttgccccttccccagaaaagcgggacttgtcgctaagggtgaaggaccaaggcaggcatccctgcgtggtctgacacctctgaaacatgggtgaataatcagagaggcgtccctgcaatgattaaacaccaaggggaggctgccttcccagtccgtgaccggcgctggagttttgggtccacggataaaacgtgtctcctttgtctctaccagaaaatgaaaggaactgaaattaagagaagggagagattgaagtgtagtgccaagattgaaaggagaaagaggttgagggatagtgagggaagttggagaacagagtaaaaagaggccgcttactggatttgaaattggtgagatgtttcttgggctggtcagtctgaggacctgaggtcataggtggatctttctcacggagcaaagagcaggaggacgggagattgatctcccaagggaagtcccccaatccgagtcacggcaccaaatttcatgcacgtccatgtgaagagaccaccaaacaggctttgtttgagcaacatggctgtttatttcacctgggtgcaggcgggctgagtccgaaaagagagtcagcgaagggagataggggtggggctgttttataggatttgggaaggtaatggagaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcagttaaggcggggcagggccttttcacttcttttgtgattcttcagttacttcaggccatctgggcgtatacgtgcaagtcacaggggatgcgatggcttggcttgggctcagaggcctgacaatttctatctgtggagtaacgcagttccccctccatgatgtgggtgggcctagtctaatccgttgaagacctgaccagaacaaagattgacttcccccaagccaaaaggcattttgccacccaacagcctttggactcaaactgtaacccttccctgagtcccctgcttgctggcccactccatcagcttttggactctccaatccccccaatcacgtgagccaattccttaaaataaatgtctgtgtatctactgatatcaatatctacagattgatatttgtgcaaagaataatttggcccaagtgtcaatggtgccaagattgagaaaccctcgtgtagaatgacaaaacttcgacgagttggataaatatcttagaatgttgttggttttatcactggttttaaacagtgcaattctttaaattaagtgtaattttttaaattaatatttttattttattattgatatatagatgtagacatataggtataaatatagatatagatgatataggtatagatacacactcaccctattggtttctctttgtttttgctattattttcaatgacacaagccgcaattacatttacaccaacctactaatacacagtgattctgagtcacctagaggttcttttttccttggctttttccaagaatccaggcttttatggcatgttcctcttattccttcttctgaatcccatttcccatcatgtccccctccctgaacatctaaactccttctgggcctgaattctgtgcttttttttggagggggggcggggtgtgggtgggacagggtctcactgtcgcctaggctggagtgcagtggtgcgatctccgctcactgcaaccttcccctcccgtgttcaagagattctcttgcttcagcatcccatgtagctgagattacaggcaaccgccaccatgcctggttaatatttttgtatttttagtagacacagggtttcacgctgtgtcacagcctgacacgctggccaggctggtctcaagctccttacctcaagtgatgcacccaccctggcctcccagcgtgctggaattacagacatgagccaccgcagcccaccaattctttgcattttaaggcattgtgtgaagctggatatttcctgggactctggcctcagtttcccttttctgtatgagtagccctgacttggagattgagtatcttctttgcacatttaactctttctaagctgctatcggttcactggggaagttcgccaggttccaaatgctgtctcatttactgtcttgcaaaatctgggttgaagaagaactgggctggcatatttgtttttggttttattttatttatttatttatttatttatttatttatttatttatttatttttgagacagaatctctgtctgtcgcccagactggagtgcagtggtaccatcttgtctcactgcaaccaccactccagggttcaggtgattctcttgcctcagcctcctgagtagctgggactgcaggtgcccgccaccacgcccaggtaatttttgtatttttagtagagatggggtctcaccatg[135 bp omitted]acttaaaaatgatgattttaaagtgaactcccggtggcatttaatgccttcacaaggttgtgcaaccaccaccgctatctggttccaagacacttttatcaccctaaaagaaaccttggacccaccaagcagccactagtccttctcccctccccagcccctggaagacaccaatctgcctactggctctatgggcttgcctcctctgaaaagttcctgtaagtggaatcctacactgtgtggcctcttgtgtctggcttctttcactgagcatagcatcttcaaggctcatccacatagaagcatataacagagcttcatttcttttaaaaaaatagtttcattggaaaggaagctctagttgtgttttcttagcactaataaaaatatttattctaagactaaattccaagcatgccagcatataccatccatgacagtggtcaaatacgaatacagaaacaaagtccagggtataattcatgtgtgtttggtacttagccctgaaactttcttgtcattatccataaagtttctttgccattcatctactgaaaatgtcccacattgttttttaatttttattttcagttctgggatatatgtgcaggatgtgcaggtttgtttcataggtaaacgtgtgccatgatggtttgctgcacctgtcagcccagcatgcattagctatttttcctgatgctccccctccccacatccacccccaaaggccccagtgtatgttgttcccctccctaaggtcaagaaacaacagatgctggcgaggctgtggggaaataggaacacttttacactgttggtgagaacgtaaattagttcaaccattgtggaagacagaggtgattcctcaaggatcgagaactagaaataccatttgacccagcaatcccaataattactgggataatacataatcccagtaatatctacccaaaggaggcctggcgcagtgactcacgcctgtaatcccaacactttgggagtccgaggcgggccgatcacctgaggtcaggagttcgagaccagcccccgtctctactaaaaatacaaaaattagctgggcatagtggcgggtgcctgtaatcccagctactcgggaggctgaggcaagagaatcactagaacctgagaggtggaggttgcagtgagccgagattgtgccattgcactccagatatatagccaaaggaatataaatcattctattataaagatatatgcagatgtatgttcattgcagtactattcacaataacaaagacatggaatcaacccaaatgcccatcaataatagactggataaagaatatgtggtccatggacaccatggaatactatgcagccataaaaaggaatgagatcacgtcctttgcagggacatgaatggagctggaagccattatcttctagttgtattttatcgggaaaacatatcagcctcctggttgggtgcccgctgacctcagacgatctgttgtcaccacatgctttgatttaatgaggatggcaaaaacagcactgctttcaatctgggctctttttcgtgtttttgtcctttctttccttttctgatgtattcacccactcaatgcaattaaaagaaactgggaggctctcatcttaaaaaattcccgataataggacattccgcctacttccccaaagcatctctgtaggtttgagtcgttgtcaagacagccctaaatgtttaggttacacacacccatctagtctatgcatagttttcttccaccagccacataataaattataggactcttgaaatcttatgaaacagggggaaacagatctaagaaaaccctatgaaacctgattttgtattacataatgccgggaaatggaatgttggaacttaggcttgccaaacagtcatcattttcaggcagcatttgaagttagggaaacagaaaaatacatatatctccctgcctgtgattatctgatggacaaatggtttattaggatatatagagagaagcaaaaacaaaaacaaaaacaaaaacaaaacgagaaatttctataacgatttcaaggcaggtgtctggaattgcgatcatattataattcaatatgtttttgtaaaacagcaatgcagaaacaagcatcttttaaactctcttatctcattgatttcattgttttactttgaataaaattaaccaagtttctatgaaaatgaacctttccaaaacaggggccagaaatgcatatttacttcttcaagtgctgcattttaaattggtggccagccaagagtgaaagaaaaagagacggggtttctccatgttggtcaggctgatctcgaactcctgacctcaaatgatcctcctgctttggcctcccaaagtgctgggattacaggcacgagccaccgtgactggcctagtgaagggtgtcttaatctgtgcaccttgggtaactcggggctgaacgactctctgtggtcgagtgtcctgtgcactgtagggtgttgagcagcgtccctgggctccacccaccaaatgccaatagcacccattcccagctgtgacaaccaaaatatctccagacatgttacctgggggacaaacttgacccacgttaaaagctcctgatgtaaaaaaaaaaaagcaataatgtattgtgccacaacttggatgaaactggaagccatattctaagtgaagtcactaaggaatagaaaaccaaataccacacattctcacttacaaaagtgggagctggtagggcacggtggctcatgcctgtaatgccagcactttgggaggccgaggcaggaggatcacttgaaaccaggagttcaagaacagcctgggcagtgtagtaagaccctgtctctacaggaaatagaaaatattagctgggagtggtggtgcgcacctgtagtcccagctactcagaaggctgagtgggggcgacttgcttgaacctaggaggttgaaggtgcagtgagccatgatcatgccactgcaatccatcctgggtgacagagtgagactctgcttcaaaaaagaagtgggagctaagttgtgggtatgcaaaggcgtacacagtagtgtaatggacattggagactccgaagtgggagggtgtgagtgcagcgagggatgaaggactacctattaggtaccatgtacaacacctgggtgatgggcgcactaatgtcctagacttcactcatccaagtaaccaaaaaccacgtgtaccctaaagctattcaaattaaaaaaaaaaatcaaagaactcctgatgtaaaatttcacatgttctcactcaaacatgggaggtaaaaatgttaaaaacctccactcatggagataaagtagaatggtggttaccagaggctgggaagagtatcgaggaagaggtgatagagtggggatagttaatgaatgcaaaaatacagttggatagaagcaagaaggtatagtatttggtactacaacagggagactatagttaacaataattcattgtatattttaaaataactaagagagtggaattgcaatgttcctaacacaaagaaatgataaaggcttcacaggatagataccccaattaccctaatttgattattacacattgtaagcttgtatcaaaatatcacatataccctgtaaagaagtacaactattatgcacccataatgattaagaataaaaaaatttaggccaggcatggtggcttatgcttataaacccagcattttgggaggcagaggtgggaggactgcttgaagccaggagttggggaccagcctgggcaacatagcgagaccccatctttacaaaaaatttttaaaaattagccgggcatggtggcacgcacctgtagtcccagctactcaggaggctgaggcaggaggatcgcttgatcctgggatttgaaggctgcagtgggctatgatcacaccactgcactctagtgtgggcaacagagcaagacttcatctctaaaaataataaataataaaataatgtttaacaagaaccactgttctagtctaaaactgcaatgcatgtctattttttctcaaatgtctgctcaccaagcgaagttttgttctttgtagtagcatcccatgatttttctttacattactaagataacatccattttcccagttccagcctctgtcctgagatattcacttccctctacacttgatataatttcagactacaatgtggaaataagggagggattaaggcagcctgacataaggtcaatctttccaggccaggagtggccctaggaaaaattgttttttctttttgggttcagataaatcacagcgaataaccatagcccagcaccgcatggctttccggcaaagacaggacctcctccctccagggatggcaggaatgtaaagtgaaagcattaccagaaaggggtcccagtccagaccccaagagagggctcttggatctcatgcaagagaattcaggcgagtccacagagtaaaatgaaaggaagtttattaagaaagtaaaggaataaagaatggctacttcataggcagagcagcagcatgggctgcaggctgcctatgtttatggttatttattgattatatgctaaacaaggggtgaattagtcatgaggtttttcaggaaaggggtgggtaattctgagggttcctcccctttttagaccatatagggtaacttcctgaggttgtcatgacatctgtaaactgtcgtggctctggtggcagtgacttttagcagctaatgcattataatgagtgtataatgagcagttacaatgaccagaggtcactcttgtcactgtcttggttttggtgggatttcactgacttctttactgcaacctgttttatcagagaggtctttatgacctgtatctttactgacctcctatttcatcctgtgactaagaatgcctaacctcctgggaatgcagcccagtgggtctcagccttattttacccagctcctattcaagatggagtcactctggtttcaacgcctctgacaaaagcgtgcttattgtgctgactgaggagggctgaatgaaatccagctggattggacagggaactaaaggaagatgtccatccatagaatgtagacaaggcactgataaatgtgataaacacagcaaggtctgtgcatggacggacatactttttttttttttaaagacatggtctcactcaggctggagtgcggtggtgtaatcacggctcactgcagccttgacctcccagcctcaagcaatcctcctacctcaacctcctgagtagctggtactataggcacgcaccaccattcctggctaattatttttattttttgtagacatagggtctcactgagttgcccaggctggtctcaaactcctgggctcaagcaatcctcctgcctcagccttccaagtagctgggactacaggcacatgccactatgccagactcattttgtattttttggagagaggaggttttgtgatgttgcccaggctggtctagaactcctgaactcaagtgatccaccaacctcagcctcccaacatgctggaattacaagagtgagccactgaggccagctgagatacatctttctctctcaccaagggctcctaagtggacatctggtccctatagatgctgcatttttttctgactttctttcaaagtcattttgaaacgtacgttaaggcttgggtactggaccctctttgactttcaaaccatcaggagccatttgcaatgtctggagacattctgagttattatcattggagagtggatgtggccagcatctggtgggtggagcccaggaatgctgctcgacaccctatgagtgcagaggatggccacaccacagagaatcctccagcctcaagtgtcaacagcacccacattgagaatcttgaactaaagaatacaaagattccacatatgagatcatgcagtatgtgtcattctgtgcctggcttattccacttaacataatgtcctccacgttcatccatgttgttgcaaatgccaacacttccttccttaagacttgatagcattccattgtgcatacaaatcacattttctttacccattcatccactgatggacactttggttgactccatattttggctattgtgaatagtgctgtaatgactacgggaaaacagataaattagacattcctcagaaagttactagaaaaataaaattataagtcaacaaatatttgtttgaagtcttcaaaagctgtttaaaccatccagaaaaatatgaattctcatataaaccttatgaaaaataaaaatggtaagctaaatgctgaaatttttgaaagcgtcaaaataatctatctacctgtctatctattcatctatccatcatctttctataactatccatccatccattcatccatttatccatccattcattcatctattgaatgtacatatctagctagctagctagctatttatcatctatccatccatctactgaatctatcatctatccttatctatctatcacatacctatctacccacccacccatctattgactctaatcatctaccattacctatgtatctatcatatatctatccatccatccatctatctattgaatctatcatccatccattcatctactgaatctattatctgtcattatctatatatttatctatgtatctacccatccatctacctattgaatatatgtatcatctatcattatctatctgacagtctaatctacttaagctctctgtcatctattataacatatttttatctatctcttctatttattctcatctctattgtcatatatgcatgttgatacacacagagaaagattgatagagatttgtaaaatgtacaaatatttaaaatgaaacttttttttaaacgggtgacatggtaaacaaggacattcactgactggcctcattcacttcctacccatccttccaatctaatcactcctagggggtgtttctgggaacagctttcttcgccacctctgtctcttcatccaagcaccactttctgcctgccccctggccagcccagcttccctgaggctcctccctgtcccctgcacccatcacacaccaagtccatgatgattgttgtttacgtgtccactcccccaccacacacatcaaaagcacctggaggctcaggggtcttcctctctggttttcctccatacctggcgcaatggtggtaaatggtagcacccaataaatgtttgagtaaatgaatagactacttagttccctttacaactgccaatgaaggaatgataaaggaaggtggtgatttttaactcctaaggtccagtaagtcaggggtaggggtttttctttatttccagctccagaaaactgctgaaaggagatgggaaaaagcaactcatttctaaaaatccctttagcataacttacaagtccctcagccagcctgcctcaaccccctcccaaggcatctggttctagttcagggcaaaggaagttaagtgtttcattataatgcttcttgcacacacacatatgcatttactgggggtggggagctttgggggaattttactaatatttgctaattttttattgacttacgtataaagaactgtaaacttaattttacatttacttatgtagaaagaactgtaaacttaattttcctttccctatgtttccctcaatttgctcaattctttccttctgattgcgatgaaatttttctagaaaatcatcacccaatgtaaaccatattttttaagtatttccctgtgccgggggaaataaagtttaaaatgatcttttagattatttgtatatttttgaaatgtttcaacaaggttaaatataattggaaggaaaagcaaagcatcatataagattaaatctcaggtgaattgaagaaaaaaataagcatttgtgcaaggccagggagtcaaaatctgattttcctctaaaggaaagaaggttcagagagttcttttttccaagtttagaaaccattcaaaactcgtgagtttgctgttttgatcatcactgaaatctcttccagattcctacccttaggaaaaaaatatatatatatatgtatatatatatatgtatatatatgtatatatatgtatatatgtatatatatatgtatatatgtatatatgtatatatatgtatatatgtatatatgtatataatgtatatatgtatatatatgtatatatgtatatatatgtatatatgtatatatatgtatatatgtatatatgtatatgtatatatatgtgtatatatatgtgtatatatatgtgtatatatgtatatatatgtgtatatatgtatatatatgtatatatgtatatatgtatatatatgtgtatatgtgtatatatgtatatatatgtgtatatatgtatatatgtgtatatatgtatatatatgtagcttcatgctttaaaagaagaaagatcaaaatagtatattaagtagtctcagaatacttcttgtacatataaaaaatactcagtgagttattataaaataaatcaaaaacagacagactgaatcttccttagattatatatgcttttaacttctaggagaatgaaggatgcaagctagaagattaatgaaagaaaatcaattacccccaaacaaaaatgtttaaaaatctcaattatagttcagattggccctttctagcaaaagtcaaaatgtggtatgcaaacacataatgtaatgccttcattcttcacacaagccttgactatgtacatggttagtgctcattgtttgaaaatccaatgagactgtaatatctgagaaaccaccatagattatgcagcaaaggcattttactgtatcaaattcaagtggtcagagacatttgaaccacagcaactccatcttgaataggggctgggtaaaatgaggctgagacctactgggctgcattcccaggaagttaggcattctaagacacaggataagataggaggtcagcgcaagatacaggtcataaagaccttgctgataaaacagcatgcggtaaagaaggcagccaaaacccaccaaaaccaagatggttacaagagtgacctctggttgtcctcactgctcactatatgctaattataatacattaaaatgctgaaaggcactctcgtgagcgctctaactgtttacagaggccatgacaatgtcaagatattaccctatatggtctaaaaggggaggaatcctgagttcccggaattgcccacccctttcccagaaaactcatgaataatccaccccttgttcagcataaaatcaagaaataacggtaaaaatggacaaccagtagcctttggggctgctctgcctgtggagtagccattcttttatttctttacttttgtaataaacttgttttcactttatggactcacctccaattctttcttgcacgagatccaagaaccctctcttggggtctgaatcgggacccccttcctggtaacaaagttacaaacaaaggaaatcctatctaaaacagatacagtcgtgcactgccacagaacgtatggccaatgatggacagcatataaaacgatggtcccacaggattataatggagctgaaaaattcctgttgcctactgatttgtgttacaattgcctactgtattcagtataggaacatgctgtacaggtttgtagcataggatcaacaggctacaccatatagcctaggtgtgtagtaggctagaccatctaggtttgtgtaagtgcactctaggatgtttgcacaacaacactgcccagggatgcatttctcagaatgtatccccatcattcagcaacaagtgagtgtaagtctatttcactgtgtgtaacttcccctactgtaagggaactcccctcagaaacccaagctcgccttggttcagacccacaatgcagcaatttaggaagagtatgcttccctgaggaggcactttagctcaaaccagccaccacttgctcactggctttctactacctcctcatcagttttagccccacagaatcaatagtgagcttcttttccatgttggaattaattataaatacaggagtaggagtttccacatttgcatgaggtaatctatttgttagttaaggacccatatccattatctattgctgggtaacaaacactcccaacacttagtagctaaagacaagcaccattttatttgtgcatcactcttgggtcacaaatttcaggctgagctcagctggatggttcttctgtgggtctcccttaaggtcccttatgtggtcccagtcctctgacagtttgactgaaaatggatggtgtaagctgggagcctattcacatggctggccattggtgctgactgtcagctgaatctttctcatggtgactcatctcaaaaaggctaccctgacttcttcatatggggtggtctcagtactctaggctgacagacaagaccgcccaacagacgtgttcatgaatgtaccttagaccatccagtctcatcaagctgccagataatggaagctgcaagaaagaccccaggcaagaccaacagaagaactgcccatctgaacccagtccaagttattgattcacaaacatatgagcaaatacaacgtttgtgatattgaggcactaaacttgtagttgattttataccaaaaaaataggtaacagatcctgaaattcatacctgaagtgggtggagggttgcgctcatacaaaagcttaaaacatgcttcattggctttgaaactgagtggtgaatgaaggttgggaaaatagtaaggtaactgctaccaaaggctagaaaaaaaatggtaaccagtggtatgttgtgttggaagagcaaaactgtagcctgcagtgacttggaagataaaaatgtacctaatgtgcttgctttggcagcgcatatactaaaattggaatgatacagataagattagcaaggcccatacaaggatgacaggtaaattcgtgaagcatctcattatttaaaacacacacacacacgtaaaataaagtcaaaaaagaaaagaaaagaaatgtacctaagaaactcagacttagaggaagtaggtttttgttgttgaacattcgcactattgacatttggggccagaaaattatttgtcatggaagctgccaattgcattgcagcattctcagcatcattctgggcctctgcttggtagatctcagaagcacccattgagtacagcctgaatttttgtcccatataacagtgagtatataacatagatttttttaacccactgcattttgggattctttgttatgtgccaatagctgaatgacacagcgtcttataacagaaacagagaatttgctcatgcaggtttcttttcttgcttcaatggttcattctgtaaatatttgcagtgcattccttgagccaaataatatctgaaatttggggataaatatgtatgaagtgatagaccttgacctgctgaggctcctttggaagcactgaggttagaacagcatcttagccagtaagaagttttcttctggggaagggagaggaggcagggacttctaggcagagaatgcaatattccttcatttgccatttatgcaacaactaattgtagagctgctagtatgtgccaagttctggagatggggaagaggataagacagacaagagtcatgctttcatggtggttacaagaagtcaacaagaagatgaatgacataattttatatccctataagaggaaatacacagctgggtgtgcacgcacatgactgtagtcccagctactcagggagactgagactggaggattacttgagcctgggaagtcgaggctgcaatgagctgtgattgtgccaccgcactgcagcctgggcaatcatggaggctgaaaactgatctgctatctacaagtggagacccaggagagccggtggtgtagattccagcataaatttcagttggagtctgaaatatattaatattttgtattttgttaatataacggagattttatttttaatacaagactagtcagaccatgtcaaaggaagagagtccacatggcagaggggaagtcatcagggagcaatttaacagctgcctgcacactattttcctttctgtgctcatgcgtttggagaatacatctatggttaaggaattagatcatctctaatcttaacctatggtattgactataaacaggctccctgtaagctttggttatttgaacgtcaatttctgcagtggaagcaaattttaaaagtggaagctcaaattggggctcccatctgggcaccacgtgtctggaacgaccgttctgaaaatgggttacgtcatgtgtggcttaggctggcatttcagcagctttgagggttggcccattagccaggtgcatgcagggccacggtatgtgggagaaataaggcaggaaggagcattgcaaggtggcatgccttgtacctggctagagggtatatgaatcacacacagagagagctggggggagagttttctctacgaaatccttctttcaagaaggcaacgtttggggtagacagtctggaagtccgtgttaattggtcttttactcatctcctctatagaatatgtctctgggtctgtgaattgatcaatcaatgcaatcagtatcagcagtatgtaagattttcttcacgaaatctcatggaggaagacccatgcatgcccagcattagagaatggattttatttgcacacaaacgcatagagaacaaatagtgtgaggacatccacgtggtaaaggaagcaaggtatggggccggcgcatagaaagacaagccacttagtgtgggtgttgtgaagggtcgggtacagaaatcatgagtcatgaacgtaggcaggggcgcatgtttgaggactttaccacaaaagcaggaagcatgcacttgatttgctgaaaaccagaagccattgatcgaagagtattgatcgaaactttaacaggaccacgtgaactcccgaaagatgaaagtgtttcccctgctatatttaaatatatctaaacgtatacatatattatgtataaatattatatttataattacatctataaatagacaattataaatatatacttataattatatatttatatacatttataattagacatatatgtctatatatttctatataatttataaattttatataatatatgatttattacatataatatatatattttatttgtataaataaaatacctataaagctgtataaaccttataaaaattgtataaactttatacaactttataaaaccgtatatttatactatattgttatatattatatgtaatttatatataatatataattttatatttataaaatttataaatttatatatattttttgagacagggtctcactcgcctaggctgccgtgcaatggcacagtcacagcttactgcagcctcaacctctgggggctcaattgattctccaacctcagcctccccagcagctgggaccacagacactcaccatcatgcccagctaatttttatattttttgcagagacagggtttcaccatgttgcccagtcaggtctccaactgctaaatatattttaaagtattaattctacactggatcttaagatatggtagacaggtttttgcttcctttaagtttgttttgtgttttgacctctattggatcagccatgatacttgagacatcttttgaaggtggttagaagtccaagctcctaataagaaattgtgacactgcaaagtctcaaaagtattttaggatttatgcatttattcctagacagaatttggaaaaacatggcttggcctgaggttttttcctagtcctactgttctataaacctatgcaaacgtattcagttttataacttgggaggccaaccaaatttcaaaagaggtacctataactcaagtcatgctgatcttagcaaacactgctcacaggccttgtgggaggcttcaccgtgtatttgttacattgccttacagttctgtgggtttatgagttggtgcaacctcagctaagaatgcaggctgctcgcgttgtgtcaatgtcgtacgttttgaacggtaaagtgtatgttctttgtgaactgaggacacataccaacgtgctgcagttcttatttccatttgctttaaggaaattatcctcatatgttaatatgtcgaacatggaagttgaggtatttagcatatcctatatcaaaactgttataaaactgagagaaaatgctaaagggaaaaattgtattccaaacaactccccttcttgtatctctataaaccttttgatttacttattttttttttaatttttctggagacagggtctcactctcgtcacccaggctagagtacagtggcatgatcatagctcattgcagccttgacctcctgggctcaagcaattctcctgcctcagtctcccaagtagctgggaccactgacacgtctcaccatgcctagctaatttaaaaaatttttatttttagtagagatggggcctcactatattgcccaggctcgtctagaacccctgggctcaagccatcttcccaccttggctccccaaaatgttggcattacaggcacgagccatggtgctgagccatatctccataaaccttattctacataattgtatttttgaaacctgcaccttacatatttgcttgtgttcattgcatttattaatcatttcacaggccccaaaggaacttcctataggttagtcgagcaaaagcccaattaacttgggcttcaagacagtctctcctaaatgatcccttcttgaaagaaagaagcatgtgctgtgcttgagaatgcacgaacgttttccatccctaaaaccagcattattggtcatagatgactccagtacaaatagccttttgaaatgtttttgtggatttcattttttgtattgataatatctagcaatgcacgcttctttctgcaaatgagaatccacattttcagattttccggggtagggaattcattcaagttttttgtgcaattgggagccttctgcaacatcgatgaaagacatgtgcaggcttcaagccctggcgttgcaactgatagggaaacagatggtgctgcgaaaggcattcttaggaaaaaatagctggaaacaacacaaaagccaaggcggggaaatatttgaaagcggcctctcggatattggggctttctgtttcaatatggcctttgcccttcctaagattagtttataataaagtcagatggatgtccttgtctgaacaaaccacacctaggatttgcaagctgctgaccatcacccattggttggagagggacagatgtaggagacagctgtttgcggttaaaggcattaaccacatttatatgttgtgtaatcattttctcagggatccagccctggagctctttttcccaaggtcttcatctcggtgtcctggcccacagaggtcactgcattggacacgccaaattacatctatatggcatcaatttggagaaaagaacactcttgcaaaaattttttttgttttatttttctctttagcaaattgcatttgttgaagtaatatccccttttgttttcattatcattagcaactttttagccagaaggatctcatcaaaacttgtcatattttctcttgagcataagggtgtaatgggatattttcccattcatcttgtctgttatttactgttcaagaaaattaccttttctctgggaacaaaagaggagtggcacagcgtgagccagagggttggacaaggacaggattatttagggctttgtgagacttggaaaagtgttggtactttgttattattattatttttctcttattctaagtgtaaaaagaagagattatagagagtaatttatgatttcaaaggctttgatgggttataaatggagaatagtttggaggaagtttataatgagaggaacagggggttcttcccgtagagccaggaagctgaggatggaggcttaaatggccacagtggaaagaaacaaaaatgaattcatgcaatttttaaggcagaaaagcgagaacaagatgtttcatcagtctgctgtttatttgcaccacggaatttttaaaattctgttacttatttcttttagggttgaacattttataaaaactataagatatttaataagaaatattggaaaaggctaggcgcagtggttcatgcctgtaatcccagcactttcggaggctgaggcgggtggatcacttgagctcaggagttcaagaccagcctggccaacatggtgaagccccgtctctactaaaaatacaaaaattagctgggcacagtggcatgtgcctgtaatcccagctactcgggaggctgaggcaggagaatcgcttg[136 bp omitted]tagagcaaataaaatttgtctcattctggaaataaaatgtcttttccaaattaaattaagagacaaatgtttagggagttctactgtattttgggcacagaataaaaataagaatacaatttccatatatataatataaataaacaaatttaaaaatataaacaaacttctagataggatggtagcaggagactgggcatataaacccacagatctccaaggaaaacccatatcattaggcagaataccacagtattacccaaacttcacagaatttatcccattcagaatttggcagaaggaaaatgaagggctatggagaagtaatctgcaaaccactttcccccaaccctaaagagcagtaaaccagtgctatggtctgaaagtttgtgttacccctaaattcagatgttgaaatcctaattcccaaggagatggtgttatgaggtggggcctttgggaggtgatgagattctgagggtggagcctcatgaatgggatgactatccttagaaaagggaccccagaaagctccctcgtcctttccaccatggaaggacacaacagaaaggcaccatctccgaagcagagaaccttgatcagataccaaatcttctggcaccttaatcttgaactttcagccgccagaagtgtgaggcttcacaatcgaaacaaatttcaattgtttatacattttccagtctaaggaaatttataattgcagcccaaatggaccaagaaagccaggggggaaaaaaagagagtagaaaagagacataaaatggatcctcattaatgcccaaggagttgcaatgaaggattgaccatggggtgaacactcacacaaccagaaaactagaaaaagaacaataggccaggtgtgctggctcacgcctgtaatcccaacactttggtagggtaaggagggcaggtcacttgaggtcaggagtttgagaccagcctggccaacatggtgaaaccccacctctactaaaattacaaaaattagccgggcacagtagcacgtgcctataatcccagctactctggaggatgagacaagagaattgcttgaatcagggaggcagaggctgcagtaagccgagactgcaccactgcactccagcctgggtgatagagtgagactccacctcaaaaaaaagaaagaaggaaggaaagaaagaagaaaagaaagaaagaaagaaagaaaaagaaagaaagaaagaaagaggaagaaaaagaacaatggtttctgagtgacgtccactccactaaacctcctttttaacaaatcctgtcaacagagaaaaactattgctcatccaaagagggataaggactcctggaggagagataattgctatttctgaaacagacttaatgcaaaagcatgcaaaatatagtaaaattatggtgaattgcatagacatgaaaacctgccttgatgtaggtaaagtttcttaggaagtggcaaatgtcagattacatcctgcggaatatcaagactgagaaatggaagaaaactcaggaagttcaaaactcaagagaccagtttaatgtaatgaaaatgataatacatttgttgttgtttcgttatgtcttaatatggagaagagattcagcaagactatataaaagaaatcattcaagaagacaagcatattcaaccaaaagaaatagtagaagaaaattttttttgaatcgatggaagacctaagtcaacagatgaaagcagcccaatgaatttgaagacatgacaaacaatgcattaattttgaaccttaatgcccatgataaaagtaatcatgatagaaatgcaatattttaaattctaaaatagtgggctaatatgtaaggtcatgttgataagctctggatggtgaatgggagtggctgaggatttgcacactcaaatgtctagccagtgagttaatggctgaggcagtgtgggctaaggagatgcaggtgtaaatgctaggacccagaattgcatgctgaatcacactgaatcaactctaaatgaaagttcttactccaggatgtcatccagagatggtgagatttttttgtaagggaaatcacccaatacaacagttttataattcacaaattcttattacattttgaagaattcagcagctcaaagaccacatatataggctggcaagccctgttttgcccacaactactgggtaatgacctcagctctgcacatctgctttctccaagccacacacatgtaaaaaatgctcagcttccttccccagcgatacccactcccctgaaccttacctcttttctcctgtttttgagggttgtaccatatctttatgtatgtaccaggatttcactcttctgctggtttgctggctttctccattctctgtctgccacctaaatttgtaagattaagaccagcagagacagaggagggaaggtgatatggttaggctttctgtccccacccaaatctcatcttgaattgtaatccccgtaattcccacatgtcaagggagagaccaggtggaggtaactggattgtggggatggtttctgccgtgctgttcttatgataacgagtgagttctcatgagatctgatggttttataaggggctcttccccctttgctcagcacttcttcctgctgccttgtaaagaaggtgcctgcttccccttcctccatgattttaagtttcctgagtcctcctcagccatgtggaactgtgagtcaattaaacctctttctttataaattacccagtcttgggcagttctttatagcagtatgaaaacagactaatacaaaagggaagaaagataaacctaagatgtgtatcctagtgtgtatgtcaggaaaatgcattggaagggagcagaattgctttgcctgacagagcaaatgaatttgggggttgttgcctagcagcagtccttgaaaggggagaaggtaaatgggaaagaacctcaaatagaccaggacagcaacagcaaccccaggtcttaaagataaagaagcatggagcgattctccttgatagggatggtgaagggagttttacaatcagcaaggtctggggttcagtgttgtgatgtctatggtgctctcactgtgtcactaacaagaatgtaatgtctatgggtttaacaaagaagggacaaagagaaagaaggggaatgatgaaggcagggctctgaacacagataatatgaagcaggaaggaaggacgtagtggttgcaccaagagccagaatttggagagaacgtgtcttggagaatataagtgccactgctgccaatatccacttccagatagccttggaaatattgggaaggtcacaaaaaagttcctgttgcaatgggatgacttcagctcttttatttgggtagaaaagggaaatgtgacctcaagtgactgaagagctctaagcactcaggcaacacttcccaatgccagtctgatgaaatcccctcttggaattctgcagatggttcaaaataaaatcccaagttttctgtaagacacccaagactctactcttcagtctcctctctttatatcatcttgatttcccttgactggtcatcctcaaaaggagagattccctctccatcacccacagaggatagggagcaatgtctggagagagttttggctgccacattgggggtgctagtggcatctggtgggtagagcccagggatgctgctcaacatcctacaatgcacaggacaaaggattatccagctgtaatggtggtagcaccaaactggataagccttgaagtagatccggtatgttgtttctaacctccaaccaatgatagactcttcctttcttccccatccctttctgttcacctggctaaatcctaactattcatactatttttggtggtcattctaatttgaatgtcagtaccaagaattgagatgactgtgcttcttattcacaatcaccaccacttatggtgagatccttcccttgttaatctgtttcttccccattcacccccagatctccactcctggcaactcacagtccctccatgaaatctgtttgacacatggcccttaactatgcctgtggtttataaaatgcatggtgttgccttgtgagtgtatgtttttcatttatagaaatggtattgtgctataaatagcattctggttattagtatcactcactcaacaaaaatgtttgcaagattcaatgatgttgctgaatatgcaacaattttgctgcttatcaattcatggtaagcatctgacacattttatgagcttgtggagtgatgcctgcctgagttgaccttcatattctaacgccacgtggaatatccggaaagtgtcctttcacacacctctgttataatttctccaggatgtgctccccagaagcaaaggggaagaataagatggaacacagggaaggaggagggtccaatgtaagaatgcaaaggctggtgggtgcagtggctcacgcccgtaatcccagaactttgggaggccg[133 bp omitted]tgaggcaggagaattgcttgagccaggaaggaagttgcagtgagccaagatcttgccactgcactccagcctgggcaacagagcaagaccctgtctcaaaaaaataaaataaataaaaaagtaagggccaagtcatgtgcaggtaggacctcctgggaagcttattgattattgattgctgccatcaattatatttcttccaagtttggcacctgtctttttttttaaagccttccttgcacctcagccctgtcccatctgctctattaggtgatgcttgttagttgtagcacctacccttccaacccaggaagagggagtcaagtgactttagcttctccatcgtttcttcctacaagttcccctcaatcctcaaatactgtccataaaaatcgtgtgctctcatgaaagtccagagatccccacttttcttcaatgtgacatgttctatctcctgcagtcaaacactcaacaatttataccgaagttatttcactctccaccacccaagtgcacacaagagctggcccagattcacttcttttcattcccaggtggctctgttagtgttgagtttcttgaactcaagttttgctagaccacagcggatatactctcacacagacaacagcctttcatactatttttgtattgtagaactatgcaaaaagaaagagagagagggagatgggggagagagtaggagagattgcagggagggagggagtgaagaaaggaagggagggagggagggaggcaggaaggcaggaaggagaaaagaaagaaagaaaaagaagagaaacaggaaggaaaggagagagaaagaaaaaaacaggaagaaagaaaaaacaaaaaaagagaaaggaaaagaaagagatagagaaaagagagaaaggaacaaatgaagaaaggaaagaatggtgagagaaggacaggagtgagagaggaaggaagaaaggaaaaatggaggaaggaaaaatatttaaaaaataaataatataggcattatatatctacctacgacctggaagcccccactttcagttgttccacctttcccaaccaaaccaatgaacaccttacatgcactgatggatttaactcttaaaataggagtgaaatatgactgcttagtttttcaaattcattcaattcattatggcatgctttctctctcttacactaaatatttttttaaagttagagatacagttattatcttcctccagcaatagaggctttggcagtatatagtttaggcacagtctcagccataacgacatcatctaagatcagaaagagaacagaaagaaaaagagccactgcagaaggcagagtgtactaagttagggcagggtcaaccctgccacacctgcaaaccacagcctttcctctgtgggactcactgcttcctcccctccgtctctctagtgcgtgaatcgcgtctctaacacacgactctgtctctactgccccacatcagggtccccaagccctaggctacacatggataccagtccctggcctgttagaaactgggctgcataatagaaggtgactgcaggtgagcaagcaaagcttcacctgtatttacagccgctccccaccgctcacattaccacctgagcaccagctcctgacatgggatttcagtgtgtaaattcctacaaaaaaaacaaacccaggtgattactggctggaaagtgttgatgtgagtacgaagcctacccctaagtccaaagtgttgatgtcccaaacccagaaagggaaatcctctcagtggttcattccccattagtaaacggaagagcaactgctgccttctgtgcatcctgattctggcagttcttttttctttcccttttttctcagcatctgaattcaggggaagattttaatggttctcagttccatcatcagcattgtcatgggaccctggaatcgtctcacagacatgtgtctcctttccttctttttattctccaaggtgggaagaaatatattatctcttgctttctccactatctcttggtttctcccttttcttgaatctcaataaaaatgtggttgtcctgaaaagtctcatggatgtgcacatttttattggttgtgattgttaatctacacatacatgctgcacgcattttctgtgtaacgcaggaatcagtactgattgcacgcccactgtgtttgcagacactaagctaagtgatcgtttcaaggggaaaaaaaaacaatttaaaactaacatgttttcttctgttggccatacttaacttaaattcagacttttgctttctaggcaattgttttcccataacaaaatgtcctgaaaattaaaagccattgactttttttttttttaatccaaaacgctttcctttgcccagataaataaactccacctgtataaatattagttgggcaggaaagaactgtttacttattattataaagcctgaaagataccgagaagggaatcttccgtttattttttaaggcaaaataatatttaaatccgctgcaacagcaggatgagatgtgagaagctaaattaataggaagagaaaaactttagtaaaatttcacattcctatcttccagtagttactctacagtcatgaaatcactgaggatgtctcatgcagcattgtatgtctgcggagaatgggctcagcaaatgtccagtcctgaaacaaatgcaggctgaatataattttcctctccaatatgaggagctatgccaagtcaggataaagccctagcggggaagaatgtaactgttagccaacgaccatggaggcatcctggacacagctacttttcttgttactctttaggctattttaaaatacaatttctctctttgccaatccttccactcaataaatgggaagcatgttctcttatttgctaacatttgtcatttgttttctttaagtcaattgtatttagtcttcttttttagtaaaagaatatggggaacgctagctgcttattcatctgtcacaaacaatttgcaacactgccctttaggtagggctttcagtgtagcaaataaaaatacagcctacccaccaccgtaagtatgacccgaatgttgtatgggatatacttacactaaaacaagatttactgtttaccccgaattcaaatttaactgggtgtcctgtattttatctgggaacccaacttttatgagctgaaactatcgctgttttgttttgttgttaaagtaccatagggtatgataaagataccattttggtctgggagagatgtttcatcgttggccttctgaggaaactattggaagccagtcattacgatgacaatgattccactgtggtctgggagaaatatttcaccactggccttctgaagaaactagaagccagacactgttgcattgcagtctgcttagggttctatcttccctctccaacaatgacaatttgctctgagggtatctgtaactttaaaagttcatacccatcatttgtagctaaacatacaacgctaggcgcagtggctcacgtctgtaatcccagcacttagagaggccaaggtaagaagattgcttgaggccaggagtttgagaccagcctgggcagcacagtgagaacccatcatgtctacaaaaataattttaaaaattagccaggcgtggtgttgtgtgcctatagtcccagctactggggaggctaaggcaagaggatcacttaagaccaggaggtcaaggctgcagtgagccacgatcgcaccactgcactccagcctggacaacagaacaagaccctgtctcaaaaaataaaattaaaataaacataagactttctcattgtgaaatatgatgttcagctatttaaattatctgaaaataagaacacgtcttttaaacatgcaaggaaagacctgccatggaattgaaatgaattagaaataaaggttgacttctacttctggattttctgaaacaaaatgaaaacatgagagtttatcaggagccccaggcaccacctcataaccctgaagtagattctaaaatgatccagcccgaggcatttgcaaaataaataaagaggccttacatttaatcagtcctattaaaaaaaaacccatgaaaacatataataataattattctgccttgagagaaccaaaactaaagcctaatcactcccaccaacccacaactagctggttataaagcagaaagttcccattttgttctctttcttggaatccataactattgggactggattctttgaagaatactaattttccaattattctgttctaaaagtagtcctcttcttatttctaagaattctaattcacccttttctcaactctttcctttagcatagaggatagtaatacctgacacaggtttgcatctgtgcacgggaccgtaacagggatggaaacagtaggtatccaatctaactctgctatcatcaaataaatgaatagtagacatgcattcatgaaatagtaaggctagatgtggtttcaaggaaaggggaggccaccacaggaaatgctaaaaccgcctttgcaaaaattataactgagacagtgtaagagatctgatctaaccaactccatcttgcttctaacctctacgctgtccttgttcattcctgggcataggccaaactaactttgggaggaacttagtttatagtttatagtttaaaacaaagacaataacagccctttcctaaaacaaaatccccttctttactggggactagactgccctcgcaggactaaccaattagccacaagactagaaattacggtttaggagtcatgcagctggaggccacgagattccaaacctccccaaattgctcctgaggatcacattactgctgcaaaacccaagatcactaaaagttttatggttatttctcagactatttttccttgttttggttattagtgtcttctttagtacttttaatacagaagagcatatatttttaaataagcaatgtatgtacaacgtaagaaaactcaaataatatgggccttatctcttatcatgttctgcaaatagtaatcattaagatggccaattattacttttcagtgatcgtcaaatgaatacatattttacaatatcacccagaaaagaagtaaccaatgaaggccaggtgcggtggctcatgcctgtaatcccagcactttgggaggctgaggcgggcagatcacgaggtcaggagatcaagaccatcctggctgacacagtgaaaactcgtctctactaaaaatacaaaaaattaggtaggcgtggtggcgggcacctgtaatcccagctactcgggaggctgaggcaggagaatggcatgaactcaggaggcggagcttgtagtgagctgagattgcaccactgcactccagcctgggcgacagagcaagagtccgtcaaaaaaaaaaaaaaaaaaagtaagcaaccaatgaaatggataaattatataaaaggttatctcata[132 bp omitted]tctactaaaaatacaaaaattagccagacatggtgttacgcacctgtaatcccagccacttgggagactgtggcacgagaatcacttgaccctgggaggcagaggttacagtgagccgagatcgccccattgcactccagcctggggcccaactgcatctcaaaaaacataaaaaagtaacttgcggccacggatggtggttcatgtctgtaatcccagccctttgggaggctgaggcaggaggattacttgaggccagcctgggcaacagagcaagaccccagatctacaaaaaaaatttaaaaattaactgagtgtggtggtacatgcctgtggtcccagctactcaggaggctgaagtgggaggattgcttgagcccaggagatcgggtctgcagtgagctatgatagcaccactgcactccagcctgggacacagagcaagaaaccctatctcaaaaataaataaatatactcaatggtcttgaagtgttaaaaaaaaatactgaagaaattttaaaattaattaaagcaacctgcagaaaaatctatactagattattaacctcaattatttaaaaatgcaaatcaaaatgtaagactttttacctatgcaattggcaaagaaaattcaaaagtataataacacttatgatagcaaatgtctgaggaaaagtgtgttaagagaacaacaacttaagccgcattaaatttaaaagagttgaattgagcaaagaacaatttgcgaattgggctgactcccaagccagagtcggctctgagattccagtgcagccacgtggtgggagatttgtggacagaaaaagggaagtgacatacggcaagtagaagtgaggttcagaaacagctagtttggtgacagctcagcgtttgccctatttgggcgcaatttgaacagttggctacatttgattggctgaaactcagtgatgggcataagagtaggctatggtccttctacatctccacttgttagagttcacaatgtaccgagaaagctttgggctgaacttaaaatatgtaaggaggcagctttaggctaaacttgatttcacaagtattttttggttgttttctatttaaactattgattgagtatacacaagaggagtattatattttctggaggccagtttgccaatgttaaaatgtaaaatgactgtaagtaacaagtttaagggtgagaggtgtggcaggaggtattcatctatcttcttttcatgtgccaatgtgtccatttaaaatactggagggggaacaagaaagaatgatggagaagccacatttctgccacattcctgatgtaggtgggtggtgtttactggcttggctaattcctcctgaccctcctagcaggcaggacagtctaaggaaaagactagaagaccttaaataaagccccttagctcccaagcccaccataaaaaggggagaaagaggaacggccttgcaaatggttcttggttcctctggggaccctaagtcaattaatgatgcctcctggcttgttccagctcttttgaggtgactattaaaatattcaagactagaggccgggcgcggtggctcacatctataatccaagcactttgagaggctgaagcgggtggatcatctgaagttgggagttcgagaccagcctggccaactggtgaaaccctacctctactaaaaatacaaaaaaaaaaaaaaaaaaaaaattagcagggcatggtggcaggtgtctgtaatcctagctacttgggaggctgaggcaggagattcgcttgaacctgggaggcggaggttgcagtgggccgagatcgtgctgctgcactccagcctgggcaacaagagcgaaactccatcgcaaaaaaaaaaaaaaaaaaaaaaaaaatcaagaattttgtgagctagttgttaaactgctggcagcttgaaatcaattatgggaagagttagcatttacaccacagcactggcaaacgctacaaatcggggctttactttacccagaggaagtggctcaccagcacaccactcttctccgtctccatttttgttttttgttttttttgaggcagggtcttgctctgtcacccacacagatacatccagatggcctgaagcaactgaagaatcacaaaagaagtgaaaatgggccgggcgcagtggctctcgcctgtaatcccagcactttgggaggcg[136 bp omitted]gaggcaggagaatggcatgaacccgggaggccgagcttgcagtgagccgagattgtgccactgcactccagcctgggcaacagagtgagactccgtctcgacaaaaaaaaaaaaaagaaaaaagaaaaaagaagtgaaaatgtctggttcctgccttaactgatgacattaccttgagaaattccttctcctggatcagaagctcccccactgagcaccttgtgacccccgcctctgcccgccagagaacaaccccctttgactgtaattttccactacctacccaaatcctataaaacggccccatcccatctcccttcgctgactctctttttggactcagcccgcctgcacccaggtgattaaaaagctttattgctcacacaaagcctgtttggtggtctcttcacacagacgcgtgtgacagagtgcagtggtgcaatcatagctcactgcagccttgacctcctgggctcaagcagtcctcctacctcagcctccaaagtagctggggccacaggtgcacaccaccaccacactcaactaattttattttattttttgtagagacggggtcttgctatgttgcccaggctggtcttgaactcctaggctgaagtgatccccctgccttggcctgctgaagtgctgggattacaggcgtgagccactgtgtccgccacaacagagttttccattctcttaatgttttgttgtttgtttgtttgtttgtttttgttttaaccatacaggagacttaatctcttagagtctcgagaggacagtggcagcctgatatttaaggagttcttttcgtctggccagccactggctggtttttaaggcgtgatgatgatagggctccaatgagtggaggaacaccagggttcttggtcctcgcgctggttttgataaaacgacatggacacatgtggagtggtttaaaggagtggagagtttaataggcaagaaagaagggagaagaaagaagctcccctgtacagagacagaggcagggggctccaaaggcgagaggggaggcccctcctgcaggggatactggccagttacatgaggaggctggagtaggcgatctgatttgcatagggcttagggaattggtttgaccaggcatgtcgtttaggtagctgcgaaaaaaaactggccttcccaccctagccttttaatatgcaaatgtggggcgccatgatgttctacacacgtggggatatgtgtgggcagccgagctgccaggcacatattgggcaagggcaagaagaagagggagggaatcgccatgtttggatggacccagtttctaatcgcctgtatttgcatatcaaaggttgcccgccgagtctaagagccggggctttcctgatagacaagaaaggtttctggagctgctttaaaagaaacgaaaactttccaaggaccccttttcctctctatctgcctaaaataatttcttaataactcctaccacaatgagaatgccagtggtagtggaaatagatcaaaaagcaaacgtggggcaaaagtccgggatgcctgtaggaaaactctgaggtactagagagttctggaaaaaagcagatttccagcagcctaaatgtacattttagtagaaaaaatgcctttcactagcaactttcacttaatacaaagcagaagggtaaacttaggaacaaaaataattct[137 bp omitted]tctactaaaaatacaaatatcagccgggtgcggtcgcgggcacctgtaatcccagctacttgggaggctgagtaacgagaatcgcttgaacccgggaggcggacgttgtagtgagtcaagatcccgccactgcactcctgcctgggcgacaagagcgagactccatttcaaaaaaaaaaaagaaataaaatgcactgtaatctgttattcaatataattggcaaaagagacaataaactacttcagaacatctactaatttacttccaaatgttacagaaatatggcaggtccacatctactagcgaatattcacgttacagactataaaacaaaacacaaaatgggcactcataacaaataaaagttttatttggcattaataacctaacatgacgtgggaacactttactatgtgattagttgcaaagttcagaagttggaggaatggggaaagatggtttataacaattttttttttttttttgagacggagtctcgctcttatcacccaggctggagtgcagtggcgtgatctgggctcactgcaacctccgcctcccaggttcaagtgattctcctgcttcagcctcccgagtagctgggattacaggtacccgccaccacacctggctaatttttgtatttttagtagagatggagtttcaccatgttggccaggctggtctcgaactgctgaccttaggtgatccgcctgcctcggcctcccaaagtgctaggattacaggtgagagccaccgcgcccggcctgtaacaatttacttagaacttttcctttgaagttgactacttgactacttgaatgcaagtatttcaaacaaaaaggagttaaatatcacatttgctacgcatgcaatttagagatagcttcacagatggtgggaacgtaccttagtatcgccattatggaaaacaatgtggaagttcctcaaaaaactacaaacagaactagcatatggcccagcaatcccacgactaggtatttagagatatctgcaccccctgccccatgttcactgcagccctattcacagtagccaagacatggagtccacctaagtgtccatcgatggatgactgggtaaagaaaatatggtatctatatatgacagactactattcagccttaacaaggggaaattttctgtcattttgacaacttggaggaagctagagggcattatgctaagtgaaataagccagacagaggaagataaatagtgcatgatctcacttataggtggaatctacaaatgtcaaatttggctaggtcaggtggctcatacctgtaatcccagcagtttgggaggccaaggcaagcagatctcttgagcccaggagttggagaccagcctggacaacatggtgaaaccccatctctacaaaaaatacaaaaattagccaggtgtggtggcatatgcctgtagtcccagctactcaggaggctgaggcaggagaatcgcttgggcctgagaggccaaggctgcagggagccgtgattgcaccactgcactccagcctgggtgacaaagcaagaccctgtctcaaaggaaaaaaaaatggaaattggtaatatctgatcataattgaattgtgtaaatcctttaatccagcaattccttttgtagaaactgttcctacaaacatacccaccgacacaaatatgcaaacatacacatacgtgtgcaccgattattttattatttattttttgaggtggagtctccctcttttacccaggctggagtgcagttgcatgatctcggctcactgcaacctctgcttcccaggttcaagcgattctcctccctcagcctcctgagtagctggagttacaggtgcctgccaccatgccaggctaatttttgtatttttagtagggatggggtttcacca[136 bp omitted]tggcaaaccacttaattctctcttcctcaggcaactggacaaattacggtgcaccttatccataagtagaatatcacaccatgactgcaagtgaaaatacagcagctatgcatgatgataaggagaatcatcactaatatagttatattatatgattatgactaatatgatattatgactactatgattatgacaataaacccaaccaaagaccaaattccttgcctgcctgcagtttgcattctagtgggaagaataataaacaaaataaataagaaaagggtacaaaccagtagaaagtgctcagtggtagagaggaaaaaaaagaaagttgggatagtggtagagagtgttggaatcaagttgaaattttaaataaagtgctggatgaattgagaagatatttgagcaaagagttgaagatggcgaaggcgaaagctatgctggtatctagaacagagaaaagggccagtggaaaggccccgtggcaggagcttatgggatgtgttctaaatcagcaaagagtccaggcatcgggagctgatgccctggagagagactcagggacattactgacagcagatcatgtagacctttctatactgttgttatgatgttattttgccttctgagtgcaacagagagctactggaggtttctgatcagaaagggagcccacaggaataattactgcccctatttgaagaatggatccattaatacggagaacagctaagaaacatgtccaccacaatggccccagtaagaagcagaacctgacccaggtctctgactcatagctcgagacacattcaagctccccagactcttacttacaattcactacactgctcatagaaatattttccatttggtaaaagaccaaatgttgacttggcgacattgagtagaaattctgagatgaattcagagaaaggaaaggtgacccatcaaaaaaagtatccttcaaatgcccactgcaagaatgaagattccagagagatctttacacctcttttctatttctcagtgcagtggcacctctgcagtgccagttgatcttggcagccatctggttggataaacttgtctgcagtttttctacccggtggctctaatcccatccaagtaaaacactgcaagagctcacattcttggcttggcatgtgggcatgatatgtcataaatttcaaaattcgaggatgaccctgttgatccaggatcttctttggcatgaagattaatcttgctgtgaaagcttaaaggaagatcaccattcgagtcttggttctttctgttttgctctgtgttcatggctcccaaatggtccccaatcttatttttctaagtagtggcttttaaccaggggagatttttacctcccaggggcttttggcaatgtctggagacatttttaattgtcaccacaggagtgggggccaagggggatactggtatctagggagtagaggccaaagatgtctatcaacatcctataatgtatagaatagcaccaaccacagagaatcatccagcctcagatgtcagtagtgctcagttagagaaaccctgggcttttgcatgagaaactctatctaacaatgtatcatctatccttatcaacctattatctatcatctgtctattcatctgtatctatctatctatccatccatccatccatccacatccacatccaaatccacatccacatataactcctgggctcaagcaatcttcctacctcagcctcctgagtagttaggactacaggcatgcaccacaacgtccagctaattttttcattttctgtagagacagggtcttactaggttgcctagctcaagttttataaattgtaatggaattgtgaagcccatataacaatgaccaaagtagatactgataaagagaactctacacatgattaagtggttttatttctgggatatgtttaagacttattttcattgtcacaaatgctgtaacatttacaatatgaaacatgacaatattaacatattataatattaaattttttttaaataaaccatttaaaatattgactaattcaaatttgaaaggctaacc[148 bp omitted]aaccccgtctctcctaaaaatacaaaaaaattagccgggcgtggtggcgggcgcctgtagtcccagctactcgggaggctgaggcaggaaaatggcgtgaacctgggaggcgg[140 bp omitted]acatcttattactatctttggagcctagaatgaggatgatctgtcatcacttaaagaacacatttaaagagcagaaaactaagctaaacttcagtgaagataaaaggatggaaaacgttaggccaaatcaggtcaagagtaagaaaataaagatatgggatcaagatacaggcaaatggttaaaatggcaggttctcctacattttctgtgaaccctgaaggagtcagtgcttcaaggtggatcccaagtcactcaatgggactaaattcaaaacagggtcaagcggccatttgctgacaagagctcacacatgtgctctaagttcctggaaaacccaaacattcttacaactttgagactttcacaactgtcaattcctatccatgcagcctgaatcaatcaatagactgtgatctgtgtcaacccatcagaattcaacaagcatcaactagtcagaactcggtaagtgtcaaccagttagaacccaacaagtgtcaaacagtcagagctcatcgggggtcgacccatcagaactcaacaagtgttgactcatcagaacccaagtgccaaactcatcagaactcaacaagtgcccaccagtcagaacccaataagtgtcaacccatcagaactcaacaagtgtccgcctatcagaactcaatgagcatcagcccatgagagtccaacaagtgtcaaacagtcagaactcaatgagcatcaaccagttagatagaacccagtgaataccaacccatcagaactcaacaagcaccaactaatcagaactcaacaagtgtcaaccagtcagaactaaacaagcatcaaccagtcagaattcaacaagcataaacccatcaggacccaacaagtgtcaaccagtctgaactcaacaagcatcaacccctcagaatccaatgagtgtcaaccagtcagaactcaacaagcagcaaccaatcagaactaaacaagtttgcattcctcagttgcctagcagaccagtgggaaccttgggcaggaactctactaaaaaaaaaaaaaaaaagaaagaaagaaagaaaaaaccctctctttgctctccagaactgtatctctctagtttgcaaactattccctggaatagtttctcttgccatttttaaaagaaaacccttttcagtacattttgttgacactttgttactgagacaagatgaattcataagcccacaaaaactaaaactctgataagaaatagttaagagttagacacatgcaattccaccaacatttctttccccttggaaaagagaacacacaaacctatccagaactccaacgtccacccagatcttccatgagagttggaagtctctcaaatggactggctacagagtcatcggccgccagaagcttacacagatattccactgccgttaggaaaagagaatccatccaactggcatcgcaaactagctcataaaaagtaatggcaacctgtaatatcaacggcactttgggcccagcagttgtttttaaaaaaaaaaaaaaaaaaaagacctaagaagttggaccaactagttgtcaatgtacaaatttacaaagtctagaaacaggggccggagaaaagaaaatcatactcacataatgccagaatactattattctaataaatgtactgcaaaatgcatatcttagccagaaagctgctgtgtgccatattaaacaatggaaatgaaatggttttgagtttttaattcacagatgtcatgagaaagcaagcaacaagtttcctctcaagactagctggcatttgctcccttgtgaaatcaccaatattgagtcccgttttaatgtggaaaagcagagagatacggagtgcagagctgtcacttttttttaatagaaaagtgcttttcaaacactaagcaagacccaagaaaggaccatggattcagttttgcaggtctctactcgtattcaaaataatttgaaatgaaacagtgctctgtgtaaccatgattaataaattcatatctgataaccctgtttctacactattaatattgttaagtttggattgtcttgttcagctgtagttttaggggcgtgtgtgcgtttgcatgtatgtgagtccggatggttctgtaaaatatgcacaatatatttctcattgtggccacagtaaagttatgaaaaataggagcttggagaatgtcttgttaagcacccattattttaaaggttatattcttgaaagaagcagaagtttcccatgttggattgttaccagatacttttcttagaaaaaaggtagagtggggttgggtgggaaaaagaaaaatcccaagaaaaaagaaaaggcatctaaacatctgtccacagtgaaatggatacttctactgtatcctgtactgactaccgcagctgactttcacaaataacgaatgatgtaccttctccagggccagctttttccagctctagatgttcaggcattctggtcattattcatcagttcaattaaaaacaagcccagtgtaaaataacaagaactctgaactctgtagaccaaattacctttcttcattcctcacttactggaatgacatcattttttaaactttgccttttgtagatttttttttttccttttttcaaggcactcattttaaaacggcctccgcacaattcctgattcattatgaattgtttttcagccagtgggtttccgagacattgcccccaaggggattttaaaagctgagtatgcagccggctcaaagccagacatttataactagacatgaaagcatgaatctattctccgtgatgtccttgagaactaaaaatgtttcagatgaaagttaagacccaggtgtgcagacctgtgtcttctctgatttgtggagtagggggtggttgacggtggttcccagggactgagaagaaggggggacaatagggacttgctgtttgatgggtgtaaaataaaagacagagctcatggggaacaatgtggattaaacacgtaaaaatttaacagggtagatgtcatgttttggtttttatcagaattttaacaattgaattgtagctttacatgtgtagaaaatggtctctttcatggacttctcaaaggtagcttgcctagtaaaataaatttgcaagtccagacatggtggctcgtgagagcctgtaatcccaacactttgggaggctgaggcagaaggattactcaagcccaggagtttgagaccaacctgggcaacatagcaagatcctgcctctacaaaaaaatgtaaacattagttgggcatggcgggggtgcatctgtagtcccagctactttggaggctgaggtgggaggatggcttgagcctgggaggtcgaggctgcagtgagctgtgatcgtgccattgcactccagccttgacaacagaatgagaccctgtctcaacaaaaataatataataaaataaatttgcaacagatgaatggataaagaaaatatggcagcatatatatgccatggaatactattcagccattaataaaggatgaaatcctgtcattctcatcaacaaggatgaaactggaggacattatgttacgtgaaataagcagaactggaaaggcaaatgtcacaggttctctcacatgggaactaaaagtagctcttacaaaaataaaaagtagaacagaggatactagaggctgggaagggtggggggaggaggggacagagctttttttttttttttttgagacggagtctcgttctgtcgtccaggttggagtgcaatggcacgatctcggctcactgcaagctccgcctcctgggttcaagaaatcctcctgcctcagcctcctgagtagctgggattacaggcgcatgccaccattcccagctaattttcgtatttttagtagagacagggtttcaccatgttggtcaagctggtctcaaactcttgatcttatgatccatccacctcagcctcccaaagtgctgggattacaggcacgagccaccgtgtccggccgagttttcttaaaggatacaaaattacagctagacaggaggaataccttctggtgttctatagccctgtaggacgactgtagttaacaataatatacagttccaaatctaggatattgaatgttcccaacacaaagaaatgatgcctgattgagatgcctgacggatttgctaattaccatgatctgatcactgtacattacatttactcaaacattggtatgtaccccaaaaatatgtacaagtattatttgtcaataaaaatgtaaattaaaattttttttaaaaaaatttgatccacagaagggttgatggactagttttagtacatcatggttttctgccttataacaaaacatcgaatttccagttccctcatcaatatactcatgggaggtcttcagcatttgatggttttaactggcatccaatatttttgtcagaaaatacagaatgctgttctttaataaatgtctaagtatttatataaaataaatatataaaaattctatacattatactaaacatataaatatatattatataaatcatattatatatacattatatatatattatacacctatactatatattatagtatacttattatgtataatatgtagatatattaaagtcctgtatatgaatatagtacatgcatatattcatatacagcactttaatatatagtactttaatatatattgtgtatatattgtatgttaatgtaacatattcatatattgtatatattaaatttaatatacatgtattgcataaatacattaaaaatatatattaacataaattatattaatgtatttattacattaatatgtaataaatatacattaatctatttacatattatagtcatatatttattctgttatgcttatgtaacacatatttattattgaagtgttgtttagcgccttggtgtgagcaggagcagatggaatggaaaccttagctctgtgattttgttttctgctgagttctcgtgtcaacagctttgtcttttagcagtggttagagtgggcaggtgtcccacgcgttgcagtatttgaaggattgaaggataactttgttgcacacacatgtaacagtgtgcatgtcactgcccacagaaaacgggtgctccccatactgcagttcctcacacctgcagtcccagcgctttgcagggccaaggtgggaggattgcttgaggccaggagtttgagatcagcccgggcaacatacggagacctcatctctacaaaataaaaataaaaaataaattaattgggtgtggtggcgcacacctgtagtcccagctactcaggaggctgaggtgggaggatcgcttgagagaaggacttcgaggctgcagtgagctgcgattgcaccagggtactccagcctgggcaacagagggagactctgccgcaaaacaaagcaaaacaaaacagaacaaaaaactccagcaattcctgtccatctctgcaaagcgatacccgagacagcctcttgttaagatgagggggtccacctaactatgattttccttcataccctcggaagaaggttatctgatcctttcaataagtatacaagatgagcctgactcctaggaaagtcagagagctccaacagggtgtggctaaatattaatacatatctatgacacataactgacacaaccctggacaatctctagcgatcttaccccaaagtacaaagcatgtttgttctgctgaaggggttcaagacccctcccctagccttccaacacacacacactccgtatcctttcccaaatcagactgtcactcaccaagaacctacgctacagaaactcccgagtggtccctgaaccagaccctgaacagccataccagcccacgggaagactcccttccccagggaattccaagatgggaccagggacagcttggtcataagtaaacaggcctgtgtttgacccttagctgggtgtaatatttcagcctctgctaatagcaagtgctatgtgagtgtcaaaaattacaaatcaattgattttacaatgtacgaagtcaggatgtttttagcaagctgcgaatgtcactcagaaacctgggtgtcaaatatgtgagtaataagagtaagcaataaaatattttattcattcatgatgatgagggcagcacatttttaacaacctgtgaagccaatctgcaaagtcaacatcacactacaacaggaatcagcaaatgctggcccttggactaaatccggccctctgattatttttgtcaataaaacctcactggagcacagccatgcccacttgtttacgtattgtctatggggctttttgatttttgtttttttaagagtcaggttcttgttctgtcacccaggctggagggcattggcacaattacagctcaaagcaggctcaaactcctgggctcaagtgaccctcccacctcagcctcctgagcaatcccaggctcgtgctaccactactgacagatttttctaatttttgtagagatcgggtcttgctacgttgcaggctggtctgaaactcctgggctcaagcgatcctcctgccttggtctcccaaagcactggaattacaagcgtgcacctccgtgcctaattatagcagcttttttgcactctgtgcaacagagactgtgtgtcccacaatgcagaaaatatctgccatgtggcccctacagataattgcccatccctcgattagaccaaaggagaaaagccacagcttgtttggagacagaagcagatgaaactcagacttctgaaaagatacaaagttttattaaacaaacctggaatcaacagtattattacataaattagacagcagtaaaattttcctagggcatatgtacaaatcacagtgatttccattgtgcaacaaacagacaggattaaaaataggcactcccctccccgaccccccatgagaaggggtcaccccgcggggttcccagttctggctcgccaaggggtgcacaaacctgccaaggcactctgcctgtgtgcgcggcatccggcggcagtgacaggggccccagaagcacgttggcaacatggtgaggctgcccagtgttcagcgcaaagaaagaattcagctacgacagttgagcagagctcaacagccatctcagagcacaaggactgtggaaaggcttcaagtctcatctgctaaaacacaattgtaatgccttttacatacagaacagacgtgtccaccatggaagatcaaactaagcctcaacagaacttcccaacacacgataatttacagaaaaccatgacagagcatccctgctattaggaagggactgttctgcggggtgcaaggccataaggtttgcaaagcaaacttgattatgaaaaggcttggtgaaaatacagcccctcaccttcaccaagacacacacacacacacacacacacacacacacacacacacacacacaccccgcaaagaaactatccaaatgcattaagacacctgttcgtgtgcttttcttcttgcttttgttaagtgaatcccatccgtttaagttagactaattagaaggcctgcttgcctccatcagcaacagaaaaacagtgcatacgactcctccaatgtgtgtaaaatgcatgctaggtagattgaaggaaaaacgagaggaacccgggcaccccatttcaaatctctacaactggagaaatcaaaggctgcaaggactgtgtagacctgatgcaaagttaactggctgcaaaaatacaacccaagccagtgctgtcttgcaccctgttcactcagtagctggagcaatgaatgattgtgacattctggtggggtatttgtgcagcctgaggtgcacctggctacagagtggagccttggggtctttaacagtattaagccatagtttcacagttacaatggtccaaagaattagaggccatgtaggtcaaacacagaaatggcgaacacatcccaaaccactcaactgtttagttccactggtgattttttttaatggacagtgatttcaaatgatttggtgtttttgttcttgtttttgctttttcttcaaagcaaacaaatgatttggtctttaagtatggacagaaagaaacaaaacgctgaatgggaaattcagtaacaagtgattgtgcagttgtttgatgggcatggagagggagtggggctgaactgcattttgaggggatgaagcgcgcaatcttaccccactgctggggggtttctgcttcttattctatcatgctgacagcaaatataatttgcccatcgctggctatagatatgtttaggctaagcaggatttagacttctgttgcgaaggaattagaagaattcagtagagacagtgtatactatttggttgtgactttatttccttcctggctttatcaatgcctatgaaagcaggccggtggcatttcccttcagaaaaacaagacttgccccaatacacttcttcttgtaacatatccatgtcctattctcttagagtattccaatttaagaaaatattgccaactcgtaaaattacatgaagcaaagtaaatttgtaatgtttttctgatacaaatgttgtgattatggtaatgaattttcctccacattttgcgcagtgattgtttgtcatgatcatccatacggacattctgcaccgtgattgtttcgtgatcatccatgcggacatttcgcaccgtgattgtttcgtgatcgtccatgcggacattttggaatgcccacccgggtcagctatttgtattttttttatttttatgttttgagacggagtcttgctctgtggcccaggctggagtgcagtggcacgatctcggcttactgcagcctctgcctcccgggttcaagcgattctcctgcctcagcctcccgagtagccaggattacaggtgcccgccaccacacctaatttttgtattttagtagagatgggggtttt[143 bp omitted]ttatagctcattttgattaaattaacctctacatgacattgggccatttaaactatgaccccgccatgggcagttaccaggtagcttgtgtcacttcaaatgctgaaatgtgtgtgatggtccaaagtgggtttcacaccatcacacgttcttggaatcgcttctaatttctcatttgttctgtatggctggaggctgatcacgacgtctgtaaagaacaaggtcaccaatgtgcttgcatatttcattttcctgcatatcagttcacaattaaggcatttcaggctttcctgatgctaattctcatctgagtatgaaatcctggataataaaacagacaacctaaaaataggcatatggactcatggatttatgtactttttaaagtgtgctcaagtgtttcatttatggttttattaataatttttaaagtagaatgttcaatattattactatgatttatttttatagtcagcaaacatgagacttaaaagcttttccttctagctccacatgtcggtgcacagtgtaaccttttcttaaaaaaatatggaatgctgcatgaatctgcagatcttcctcgcgcagggggccatgctaatctcctctgtgtcattccaattttagtatacctgctgccgaagtcagcaccagtttcaccttttcacattcacggtaaaactgatgggaaaccgcacgctaaatgtttaggcagcgatggccctcaactgttaatcccaacaggatggtgagtgagaagcacaggctgaaaatagagttgtctaaaacatttccacatttcaccatctgaacatcattttccactgagttattaattgtaaagagtttattctgctgaacctactaattattctcacctactgagttgacctccacgtgaagaaaaggtcactgatgaaaaagggtggctatgttctgtttctgtaatttcactgttttaacatctttttttttatatagagatggggtctcgctatgctgcccaggtcggtctcgaactcctaggctcaatcttcctgcctcagcttcccaaagtcccagggttacaggagtgcaccaccgcacccagcttcactgtcttttaaagccttaaggtggacgttctcttcaatccatcttcaaaagcacaaagccattgccttctttttttttttttttttttttggacagggtctcactctgtcacccaggctggaatgcagtggtgtgatctcggatcactgcggcctggacctccccaggctcaagtgatcctctcatctcagcctcctgagtagctgagactacactcacgtgccaccatgcccggctaatttttttgtattttgtagagatgaggtctcaccacgtttcccagactggtctccaactcctgggctcaagcaatccacccacctcagcctcccaaagtgctgggactataggaacaagccactgcatccagctcagatgaaatttttgaatgtgtcacagaaggtttttttaaatacagtacattcctccaacaacttcaatgtcattgtagattcttggaataaattcgctcccatatcttcccctctttgtttcttcttttaaagtctcaagttaccaggtaagaagcactaaagatactgaaggtagacctccccatgatattttcttccccaaaactataaaatgcatgtgagatgattttttttaatgcatgcaacatacccttcagatgttgtccccgagaagagatttttgaaaaaacaaattgaaaaataaaaattataggctctgtaaagtatgaacatttacatcactgcacaatttctgtgcatctgccataatgacttctatatatacacacaggcatacacacacacacacacacacacacacacacacacacacacacacaatttgtggttataatcgaacaagtccagttcaaacttataaacttaagtctatgacaaaaaccaagacatcacagtaggaacacaacactaaaggataagataaaatctacaaccaaacaattttcaaaaccttcctacagtgtggaattccagttgcttaaataatgccagttccatgaatttcaactgtgctctaatctatttctatacacacaggtacagagaaaagtggagatgtccttatgccgtgaagaagacattttgcttctggtctgcttaggtgcagttctttgttccaggcagattccaatcttcctgtttctagcatgaaataggacaaaagattctgtgagttgctcagtaactggatgaattttgtaatcatcatctcaatgataatacaaaggtttcctttccctaagtgataacaaagaaaacctctctttgtaattctttttgcaaggatccataagcctgaattctaaaaggagaggccaataaaaaggaaatgaagaatgttttaaaggtaaggggtttttttggtttgtttgtttgagacggagtcttgctcttgttgcccaggctggagtacagtggtgtgatctcagctcactgcaacctccgcctccatgttcaagtgattctcctacctcagcctcctgagtagctggggttacaggtgcccgccaccacgcctgggtaatttttgtatttttggtagagatgggatttcaccatgtttgccaggctggtctcgaactcctgacctcagatgatccatgcgcctcggcctcccaaggtgctgggattacaggcatgagccacctcgcccagccctgttttcatttttgagatgaggtctaactctgccatccaggccggagtacaggcacaatcacggctcactgcagcctcaactttccaggcccaagcgagcctctcacctcagcctctagaatagctgtgacaataggtatgtatcactacgcctggctaacttttttattttttgtagagatggggtctcactatgttgcccaggcttgatctcaaactcctgacctcaagtgagcctcccaactcggcctcccaaagtgccgggattacaggtaggagccaccacatccagcctgaagaatgttctatcatacgcttatccataaatagataaatgtatccaccaatagatgatgaactgcacaagaaaaatgggatccccaattcaacatgcttcctcagagaaccttacagcaagacagaaaatattttattacaaagtaaaataaaagacatagtgagtcagttctcttaaattcctcctccacattcagaaaggcatacagggtgattcaaacaaagatgaacggctacagcatagtttctaagctgccctcaagtgcagtgattcatctgaactggtgtcttatttacaggagaagatttggcttcatgaagaaatatcttcctgcataaaattcctgcaactaatcgctcgttgctgaaaatgccagggatgtgtttggtgtgcaaattacttgataaaa[132 bp omitted]caaaacccatctctactaaaaatacaaaacaattagcctggtgtggtggcaggcacctgtaatcccagctactcgggaggctgaggcaggagaatcacttgaacccaggaggcggaggttgcagtgagctgagatcgcaccactgcaatccagcctgggcaaccgagcgagactctgtctcaaaaagaaaaaaaaattcattaaacagagccccaaccactagccaaactatattaaaaatgattccacttagcaaaaataatacttacttacacatactttctcaacaatgcataccagatggagaaaggttattcctacgtgtggaatctttttcagggaaagtaggggcagctggggacaggatgtaatgaaattgttcactgattatatgacaaaaatccatcaaatggaagcttttttgttctttaagtaaattttacaattgaggggtctctattagagaaaggttctatttttgtggcttatcaactaggggtccttcatactaaagcaaaccaagtctttacatcattttaaagatttcctggagagacacaatttgtaagatgttatgggcgagtcagctaaaatgtaagccccagagtagagcagagaaacaaaaagaagtaaacacattcaggaacatcttatgatttttaaaacccgcaactggatttcatgagcgtttatgaagttggtaaagttacacgctctcatgttaatacaaaccagtcaccactgtgaaagcgttcatcacacactgagaggtgaagccatgccatggagacaggttatcttctcgaggtcatagccacctattcctctatcattttgttgtctattatttcaatttgtatccagctttcctcttggtacatccatgtaaacacctgcccaggatggagggctctcattcaccacgtctttcagcaggttggttcctctccccagtcagcaattgtgacatttggtgtctgtttcgaatggtgttggttagccaattggctttccacttcacataactgggaagactacaggaaaattacgggaatggaaatcaaaatgggaaaaacaagctatgtcaatgaatagacacatcactgacaatattttgcttcactggtatgtttcttgctcgtgtgttacaggaagaaagatctaattgaagccatataaccgagcaatttagaattgaggagtaactgaaagctctttttaatccatacttaaaaactaataatagattttcaaaggctcaaggaaataacacagtcaaaaccctttttcagtcatcttaaattaaagcttagcaaatttcatgagggattctaaaaaatattattattatttaaaaactaataatagaccttcaaaggctcaaagaagtaatagactcaaaatccttttccagtcatcttcaattaagcttagcaaatttcctatgagggcatatttcttcttcttattttttaaccaaaggagacctaaagagacttttgaaaatacttgttaattattctaaggaagctcgcctgtcactcagggtttctggaacagggaccagaggagctgggcttctcaaatattcaggcacacacaaaccacctagcggtcttatttagacatgcaggttctgatgcagaacatggattctggactgtcatgctgatgcctctgacggtcacatgctgacctggagtcacaggcatggctgtgtttatttcgctgacccttgcaatcaatcccctttgctctgcttcactgctgacctctgtgtgcatgaggttaagccccactcagtaaacgcagcctcacctggatgtggggtcgagtcagtctcattttttgggaattactaaatataaagatataccttccagatgtgagctcctgtcctcagaaattcttgaagatttctaaatccttctgcggcacgggcgcggctgtgtcccagtcattctcagggtaagtttcgaagttggaagtgtcgccgtcaccagctatcttgggcacgatgggaggctgtgagacatggccgaagcacaaaggcatggttagaaagggacgggacacttggatgctgcacacaccgctttatttctgtcactgtacctaaaaatgaaaatgatttgcaaaacactaaagctgtcttcccttcatttatgaaagcggcaatctttgaattaaaatattgtgaatgaggctgcgtgtggggactcacacctgtaatcccaacactttaagaaggtgaggcgggagggttgcttgagcctcagaagtttgagaccagcctggggaacacagggagtcccctgtctctacaaaaaatacaactagccgggtgtggtgctgtgtgcctgcagtctcagctactcagtaggctgaggtgggagaactgcttgagcccaggaggtcgatactccaagtgagccatgattgcaccactgcattccagcctgaatgactgagtgagatcctgtctcaaaatatatatatatagtattaagtaagctatggtacagtcatgtgatggaatacaatgcagtattttttaaaatgaggaagctggctaggcgcagtggctcatgcctgtaatcccagcactttgggaggccaaggtgggaggatcatctgaggtcaggagttcgagaacagcctggcccatggagaaaccctgtctctaccgaaaagacaaaaattagccgggcatagtggtgggtgcctgtaatcccagctacttgggaggctgaggcaggagaatcgcttgaacctgggaggcggaggttgcagtgagccgagatcgcaccactgaactccagcctgggcaacggagcaagacttcgtctcaaaaaaaaaaaaaaaaaaaaaaaaaaaaaaaaaaaaatgaggaagctagccaggtatgtagacaggtctccagattatatagtcaagtgcaaaaagcaagactataataatgtacatactacgctactctagatttgtataaatgagtggcaaaaataagaatgcatgtatccatgtgggtttttattagcacaaagaaactctagaaggatacacagaaaaacaataaaaggtgattacctacaggtggcttggagggggtaagagggagacttggcaatatatctgttttaatattgacttggtttttgaccaatgtggatagataaaacgtattcaaattgtttttttaatgcaatttaatacaataaagtatttgaaaa[131 bp omitted]tgaaaccccatctcttctaaaaacacacaaaaaaattagctggatgtggtggcgcacacctgtaatcccagctacttgggaggctgaggcagaagaatcacttgaatccaagaggtggaggttgcagtgagttgagatcactccactgcactacaccccgagcctgagcgacaaagtgagactccatctcaaaaaaaaaaaaaaaaaaaaaaaaaagaagcgtatcatcccaggctccagccccagaaactctggtctgagctgaggactaggaataagcatttctaagcattctccattcttttaactctgaagtgcaaaggtgaaaacactaccattgaccactcccatcagtaacatatgcagttcagagtgttcacaaaagccaagatatggaatcaacctaagtgtccaccaatggatgaaaggataaagaaagtgtggtccatacacacaatgaaaaactatccggccataaaatggaatgaaatcctgtcatttatagcaccacgaatggaatgggagaccatcatgttaagtaaactaagccaggccgggtgcagcggctcatgcctgtaatcccagcacttctttgggagactgaggctggtggatcacttgaggttaggagattgagaccagcctggccaacatggtgaaaccccgtctctagtaaaaatacaaaaattagctgggcgtctgtaatcccagctactcagggggctgaggcatgagaactgcttgaagccaggaggtggaggctgcagtgagcaagatcgtgccactgcactccagcctgggcaacagagcaagacgctgtctcaaaaaataaataataaataataaactaagccagacgcagaatgagaaacacagcgtgttcccactcatatgtgggagctaaaaaaatggatgtcatgaaggttgagagtagaatgatagttaccagagggtgggaagtgtgtatagctaggggatgaaggggagatgaagaaatattgcataaacataatgttagataaaaggaataagttccagtgtttgacagcatagttgggtgggcagagttaacaatatattgtatatttcagaatagctagatttgcaatattcccaacccataaaaatgataaatgtttgagctgatggataccctggttaccctcagttgatcattacacattctatgcgtgtgtcaaaatataacatgtacccccataaatatgtacctgtgatagttacactgcttagcagctgtgtaaccttccacacattgcttaacttctctgagcacagt[132 bp omitted]ctgcaacctccgcctcctggtatcaagcaattcttgtgcctcagcctcccaagtagctggtaccacaagcatatgccaccacgcctggctaattttggtattttctgtagaggcgggatttcaccatattgcccaggctagtctcaaactcgtgggttccagtgatctgcctgagttggcctctcaaagtactggaattataggcgtgagccacagcacccagccaaaaagccagatgtttaaaaataggcagtttggccagaaacgttccaaagaatattctccatgtaatacaccaccatcactgaacgatgaccatggtgctagacgcttgcttatctctgtaatcctgttgaccgctttccactaaagaggagggagtagggtttagcagtcacagagctagtcaggaatcaggccaggtctcctaaaatctgcttcaaaatctgggataagtgtccatccagggatgaatggacaaagaacatgtggtatatgactgggtgtggtggctcctgcctttgtgggagctaggtagatggttagcactaagacactcaaagagtggggaacttggcttatgaacagttttagacaaatagttgtattatataaattaatcacatgtcagccatcaataaagaagtcccaggattcagaggcagtccctgctaatggaagagctcgggcatactgagtcacccactgatatgtgttgtaccttcagttttctctgcggaacagcttcccagtccacggagcggaaccaccgatgatgcttcacatcattcgccccgttcttcaaaagaaacaacacatgtcgtcagtgtacagaattttgacagggcaggaaagaaaaataccccaaagaatctctacattattttagtattgaaacaaacagaccaagtttgctgcattttggagaactgtgcctggagggtgagctgccaggaaaacctgcaagcaaagctgttagtgttttgtttgcccttttttgccgcagaaacaaatccagtcattctgctcctgtgcaatgcatttgcattccggaccaaagacgaaaaaggtaaatacgattccatctctcgacataaaattggacagccagtagtttctcagtttgtctcctgttttcatcttggcaaacttactcagtattttacagacatagaaactagggttcaaggaatgatgttaatttgctccgtaggacccagcaagtaaataacaagactgggaactcaaaccaaggatgtccagtttaagagaccttaggaacgacattgcacggcctggcaattaacaaggtgcgttcaagtcggcctgcttcatgctcaagggtagcaccaggcatcgctggctcacactgtggccatcacgacctctgaaatccctcccaagtgctcatccgtaaacctcactctgcttccttttcttatacttgtagtgatgtcgttatcaattaaatgtgggacagcagaagaaataaacgtaggttccatgaaacagaagccagtacatctgaatttaacgcgtctatcagttagcattactgtagtttcaaatttcttatccttaaagaggaatacgtccacaaccatatcttcaaaaggaaacagtaatgtgaattttttctattgttttcccatccagttgttttgacaactttttcttttcttattgcaaaacaggtatttttgatctatagctaagtcaggcaacaaacaatagctgttgagttttcccttcagcaatgttgtgaataagaataaataagagtgctgtgaataagagaataaaataaattttatccatcagataaaattctaatttggatactaaaggatgtgtgtgtctgtatatactcacatgcatacatagtaatatatacacacacacatacatatatacacacatagattgatatatacatacttatacacatacacacattaatatatacacatacttatagacatacacacgttaatatatacatacttatacacatatacacgttaatatatacacacatatatttatatatacacatacttatatacatacacgttaatatatacacattaaatatacacatacttatatacatacacgttaatatatacacatgtattatatatatatatacacatatacatatgtactttacacactttatatgtagagtacaaagtatatgtatataccgagattcacattagtatccaaactagtgtgtgtgtgttatataaagtgtgtgtgaggggggtgggagcagtggctcacgtttatattccagcactttgggaggccgaggcaggaggactgcttgaacccaggagtttgagactaacctgggcaacaaagtaagacctggtctctacaaaaaaacataaaaaattagccagccttggtggtgcatgcactgagtcccagctactcgggaggcggaggtgggaggatcacttgacgccaggaggtcaaggctgcagtgagctgtgatcgcaccactgcactccagcctggatgacagagcaagatcctgtcttgaaaaaataaaaataaaaaaagtgtgtgtgtgggtgtgtatctacagtcatgagcctcaaaatgatgcttcagtcaacaatggatgacatatacagtgttgctcctgtaagattataatgatcttaaaaactcctatcccctagtgacgccatggccattgtaaccacaggacaatgcatccctcctgttacgctgccaggcgtgtaacagtctaacacatacgttacctacggcacctaatacttggtaatgataataaatgactatgtccctggtttatctatttactatactctatgttctttttgggggggcggggcaatggacagagtttcactccatcatccaggctggagggcatggcgccatcttggctcactgcaacctccgccttgctgtgtctcaaaaaaaaaaaaaaaaaagagagagagagagagagaaataagccaggcacagatagacaaatacagtctgacctcacttacatgggaaatctaaaaaagttgaactcatagaagcagagagtagaatggtggataccaggggctgggaaggggctgagatgggaagtcattggtcaaaagagacaaagtgagagagacaggaggaacaagttcagtcagtggcttgcacagctcggtgactataactaatgatgtattctcaagaatctctggaagagtagatcttgctgggtgcagtggctcttgcctgtaatcctagcactttgtgaggccaaggtgggcggatcacttgagctcaggagctcgagaccagcctgggcaacacatcaagaccccaactcttaaaaacaatttttttcttagatcttaagtgttctcaccacaaataaatggtaattatgtgaggtaaggcatatgttaatgaactcaatggacccattccacaatgggtacatatttcaaaacttcatgttgtacatgctaaataataccattttcatgtgttaatttaaaaaaaaaataaaataaagtcagtgttttcttgagtctctttcagtttatctccatatcaggaagctttaactagactttaagacctagcttgggagtttgtgagcttttccccaattcctttgattgggaaacttgttcttcccccttggaaggtacctatgatggtcactacgccattcccagcagattctagatatgggtcgtctgtgattccctgcagtcccagcaagagacccagctcttttctaaatggctgtggcattaaaacaggactcgtccaatcttatgaagagccgtggcacagatgagtccacaccgtgcaacctggctggataggctcctcggagacctgaaggtatccgttgctgtccgcaaataatgtaaaggacagaagcttgactactgttatagggtaaacaatgtccctcaaaaagatatgtgcacatcctatcccccagtgcctgtgaatatcactttatttggaaatagggtctttgcagatgtaactaaattaaggttcttgagatgacatcatcctggagaagggtgggccctaaatccagtgacaggtgtcctcataagagacagaggaggagacacaaacatagagaaggccatgtgaaaatggaggtggagactgcagtggtgtggccacaagcctagggatgcctggagcccccaggagctgggagaggcaggaaggatcccccactagagcctctagcaggaagcagacacaattatcacacattgggcagtggccctcaaaatatatgcccatgtcctgactcccagtacctgggaatggaaccctacatgcaaatagggtctttgtaaatgtaattaagggaaggctcttgagaagagataatcctgcattaggatgaccctaaacccaatgacaggcatccttctgagagacagaagaggagacacagacacagagaaggccacgtgaagaaagacagagactggagtgatgcggccataagcccagggatgcccggagcccccaggggctgggagaggcaggaatgatcctcccctagagcctctggaggcctgagacaccttgatctcagactcctcgtctccaggatggggaaagcagaaattcctgttgtttaagcccctagtttgtggtcagttcttatggcagctactggagactcgtaaaccacacagagggccccaagagagccaagtggttcaagcctcacaccccggtgtactgtgtctctccagactgtaatttacagggtcaagacgtatatggaagttcctccatgtataagtccctctgaggttgtccagagctagaaatggccaacaaaaagtccatgaattctgtcaaattcagggatgtcaaaacacgcatatcaggtatgatactacttaaggaatagtctgtttgtcaattatatacttgcctccacacaaaaagtttgtggaaatcatacctgatgcacaacttttaaaatcatcacctgcgcacacaaaacacctactctcatgtccatggcagaaccattcacaaaagccaaaaggtggaaacagcccagatgtccatccatagatgaatggataaacaaaacgaggtctgcccacacaatcgaatactatgcagtcaggaaaaggaaggaagctctgacacgggctacagcctggatgaaccttgaagacatcgtgctcagagaaagaagccagaggcaaaagcttacattttgtacaattccatttttagcagagcccagaacaccgaaccctacagagaaagtcagtagattagtggctgcttagggtaggggtccccagcccctgggccacaaactggtagtggtccacggcctatgaggaaccaaaatgggccgcacaccaggaggtgagcagcaggcaggtgagcgaagcttcacctgtactgacagctgctccccatggctggcattagcacctgagctccgcctcctgtcagatcagcagtggcattagattctcataggagcacacaccctattgtgaactgcgcaactaagggatttaggttgtgcggtctgtggaaaaactgtcttccacaaaactggcccctggtgccaaaaaggtcggggaccgctggcttagggcaagagaggatgaaagaatagcacagtgataactgaagggtgcagggtttctttttttgaactgatgaagatgttctaagattaaccacaggggtggctgtacataatcgtgtgtatactaaaagccaccgaattgcacattttagatgggtaaatggcatggcgtgtgaattcactctccgtaaaactgtttaaaaaataaaataaataagtaaacaaaataatgagtaataacttatgcattgttattgctctattaaccttgcttgaggggaggggagatacggtgtagacccagtttgacgttgtgggcccagaaaccgagatttgatagatctttcctggcagtttcaagtaaaatttaaaaaaataaataaaacaccagatttgaaatttgggcagtgattaaatacgaccgctaagccttggtttatacctgcacatgccaatgtgggtgttagacggcagacacgcacatcgggtaccactgaatacccacgggatcaaatactgaccttcatgtttcctaatcgccttgttctgtcaaccacgagcagtttcttaatgaggtctctatgttggggaaggagacaaaaaaaaaaaaagtacacagattatatatcaacatcagcaaacgcagcatggcaacagagataagatctatctgacatgaggaccgcagttcaatttccactttggcaaaacactttctagtgcttatttcctaccatcaccggctcttaaatcacctatgcaaggctgggttgccccgtgcaaggctgaagctaagggaagggggttgattacatctttgtaaagaaaatacacctctgagtagaaaagggtgaaatttatatgtgcctgcagggaggatccagacacttaacgtaaacatgcctgtcaggctgtccctgcaaaatagaagacatctgctttcaccaacatcaacactcacgcgctgtcctgggggtctgcttattgatgggattcctgttttaaaaggctggctttcccataagcacacacattaggatgagtctcctaagtctgcttcttcacttataatcttccttttaaataacagaccatgtcagaagtacagcaggtggggaggttgggcatactggctcacaccagtaatcccagcactgtggggaggccgaggcgggtggatcacttgacgtgaggagtttgagaccagcctggccaacatggtgaaaccccatctctacaaaaaaaaagaaaaagaaattcgctgggcatgctggcacacaactgtggtcccagctacttgggaggctgaggcacaagaaccgcttgaacccaggaggcgaaggttgcagtgagctgagactgagccactgcactccagtctgggtgacagaggtagagtcagtctcaaaaaaaaacaaaaacaaacaacaacaacgacaacaaaaaacagcaagctgcttcaattaggatgggtagttggagatgatgttgaagacttccaggagattaggtgagttctaaaagatgcatatttatggaagtagaaatgatcatgtgtgtctgtgtgtacacataaaatacacagagtacattatgtataataacatacataatatgatataataatataatatattgaagtcccccaaaacaatccaatacccatgaccccggtgtaagcgtctaggctttcccagcataaactatgccccaaggtaagtagcacgaacttggactgagccactcccaggttctgtgacagactgtggagtctccgacaagccaggtgacgtcctagggtcagactccaccatctagattgtgaatctcgccagtgctgtctgatcggaaattttacagtttcctgccaccatgctttctgaattaggatgggatgcttgtcagacttcaccgcttctctgccacaaagtaaaactcagagaccatctgtccgcccacctaaggctaggattttgtatccatcctgtaaggctgaaaagctttgagcaggatggggaatataaaaatcacctaaaagttagaaacctttccactacttagtgagtttctccttcattattttgacatgctcccccctgccaaaaaaaaatcaaggttatcaaacactatacccccaaaacattcccaaataaatgtggggcttcgtcccccacgtgatttacaccactgcctgcccccttaccacacacacttaaagctcactggagtgcaattataagacaggtttatttatgcttttatattttagataaacctttgttttcttataatcccagtccaatcagctttaagtgtatacgctaatggggcaggcagtggtgtaaattataggggggaaaaaaagccctatgtttatttcagaatgttttggtgatcacctgataaatttcaacgtgtgtgtgtgtgtgtgtgtgtgtgtgtgtgtgtgtcatgtaagaaaacaaaatgtttgatgaccttgaatttttttttaaatttttttggtgtttggcatgtaagaaaatgaagatttatttaaaatacaggggacagtggcttgtaatcccagctatgcagtgggctgaagtgggaagaccacgtgagaccaagagttcgaaaccagcatgggcaacatagtaagaccctcgtttctacaaaatatcaaaacattggccaggcatggtggtgcatgcctgtagcaccagttactcgggaggctgaggtgggagtgtcatttgagcccaggacgtcgaggctgcagtgagctatgattgtgccactgcactccagccggggtgacagagcaagacacccgtctctttaaaagaaaaagtaaaataccaaagcaaactcttataaagcagtctagaaagtaaagagtatggatgagaagaggcccctgaagatgcaaagccctataaaggaacgacagaagtgtccacagctgtagatgggtcccttgaccccgggataagcgacacatctgccggcactcttttgatgcactgtagccaaaattctacattttatttacgatcctggcaccagctggctcctctcagatgcaggtactttcaggtgttgtaaaaaacaccggcagataatacctctactgaattggcaacaagtcccaaagctttgttttggtgttttgttttaaatgatatttatttctataaggaatgtcaatcctgatgtgccatttgcccaggcgacatgtttacctggtcaaatgataaaagttgcaggaaccaacatatgactttaaaaagcagagaatcaaaattctagcatcatggacaaccagggacagtgatttggataagaaaaatgcctcattaaggccaggtgcagtggttcacgcctgtaatcccaacacttggggaggacaaggcaggaggatcagttgagcccaggagttcaaaagcagcctaggcaatgcagcaagatccccatacccatctctaccaaaaaaaggaaagatatgagtcattgaggtcttgcttctcagccaatttgataagatttaacaaataatgggaagaagtgaactgtcagttcacttctatctatcactgtttctgctcttggggaacccacactgggtatgtaaagaaacaggggcactgtggggaacactggaaggggctgggagctgcataaagagaggcatgttagatcagacagtaccaagatggtcgctgctggttccctactctcaaagaagataaactaggagagaaagaaggacaagtggcaagagaccagactttgattacgcttctggtttattctatttctgcaattcctttttttgttgttgtttccacagaacattggaaaccccccccatatatatatataattatatcttttaattttattattttttcttttcttgacacagagtttcactctttcatccagtctggagtgcagtggtgcaatcataggtcactgcagcctcgacttcctgggctcaagcagtcctcccatctcagcctccctagtagctgggactacaggcacttgctaccatgcccagctaatttttaaattttttgtagacatggggtcttgctacattgtccaggctggcctcaaactattggattggccccaagcaatcctcccacttcggattgctcctgaagtgctgggattacaggcatgagcacctcacctggccaaactcgatcataaaagtgctttgccatccacttaatataatgtcactcaactcagatgggatttggggcctgagagagaggttctatataatcctttctatttccttccagagcagtcggcttctgaggtgctgtttcccctgacacctccctgtcttaccattcactggacagggtgtcccttctaggcgactcattgttaagcggagcctcgttttcttgctaaagtcttttaaagcctgcctcttagtgtgtcaaacacaacacatgctcaagccaataaaacacgaccttatcttctgttcagactaagaacctctggttaggatggggtgcgttcaccaccaagaaactcaactgaacgtagccagtggccccataaggggcatattcaaaacaacctgctccatcgccctgaaataagtcttctctgaactgaacttccaccggctcataagaaaatagaccatggaaaagaaaagtttaattctcaactagatgcatttagctctagtttgtgcccagggggctggtgcacccatcaactcatctgaaaaatacagtgaaacaaacagaaatcagtgcttattacagtaaaaatggctaccagttgaccagattgggtaaggtagccagaaaaccaaaagcattcttttttttttgagacagaatcttgctctgtcgcccaggctggaatgtagtggtgcgatctcagctcactgcaacctccgcctcctgggttcaagcgattccgctgtctcagcctcccaagtagctgagactacaggcgcccaccaccacacccagctaattttttatattttcagtagagccgaggtttcaccgtgtttcccaggatggtctcgatctcctgacctcgtgttccacccacctcaacctcccaaagtgctgggattacaggcatgagccaccacgcccagccgcgttcttatatttaagaaaataatatattttttccctactgccacgacctttataaaatgtgcatccaaagttgccaatatccagcaactgtaaatatccttgaagcaacatgctcagaactgaaaatgttgacgttaaaaaggacttagaggttgagcataatttaagcaggagagaaaggataaaactctgctaaacccatcaacagttctgttagccacagaactaggaggatccttcttgtcaaattccaaaactgctctcttataaaatacgatgacaaactcgttcattggctcattttaaatataacataccaccaaaagaacacaatacggccaagactcattaaaatgtgaagctatcattaaagtagaatactgaaaatctttttcttttcttgtggaaaagacaactgtccaaaatagtttatgcgcagcacatttaataacacaatatggtatcctgctgagtgcgtgctttcacggtgattttagacactttaaaaataaacacacctcatgatgaggcaaacggtttacttactttacatggaaatccaaatgtctggggaaatctattttgcctgcaagaattttctgataaatgccaaacgggttgtcatcaaaaaacggaggaaacctgttagaaaaacaaacatgtatttttagtggggagtaagcatggaaaaaaatccctgctttgtaacgatagctatttctgcttcacacaggcagaaggtaatttatttcacatgctcttccccgcacactgaagttgtcacgatctgaaagcacgtgacagtcagatggttctaagaggcaaggcatcgtgtgccacagtccgatgcaggggaagctcccttggagagaatataaagaccatttgagaggcgtctgctgagcagaaggcaactcctttttgggcatcttattgaggggccaccagcccattccttaactgtgcactaaacactggacagcaatgctctctcatgtttaccggggtgaatccaccaccatgaccaagcatggaactcaaatgtctcaagagcgaaaagataagcactccaattaaaaaatggacaggtggtcttcacagacatttctcaaaagaagacatggaaaaggccaacatgtatatgaaaaaaaatgctcaacgtcactaatcatcagggaaatgcaaatcaaaacctcaat[139 bp omitted]atctctactaaaaatacaaaaattagccaggcgtggtggcacgcgtccgtaatcccagctacttgggaggctgaggcaggagaatcacttgaacccggaaggtggaggttgcagtgagccgagatcgtgccattgcacttcagcctgggaaacaagagtgaaactctgtctcaaaaaaaattaaaaaaaaaaaaaaaaaaagacacatacacacaaaaataagaaatgctggtgaggatgtggagaaaagggaactcttttttttttttgagacaggatctcgctctgtctcccaggctggagtgcagcggtgcaatctcagctcactgcaacctctgcctcccaggctcaagcgatctacctgcctcagccttccaagtagctgggatcacaggtatctgccaccatgccagctaatttttgtatttttttttgtagagcgggggtttcaccatgttgcctaggctggtcttgaagtcctgggctcaagtgatccacccagcttggtctctcaaagtgctaggattaccagcgtgagccactgtgcctggccaaaaagggaactcttacgcaatgttggtgggaacgtaaactagtagagccaccatagagaagagtatggaggttcctcagaaaagctagaaatagaactcccatatgacccagccatcacattactaggtatctgttcaaaggaaaggaagtcatgatactggagagacatcggcacgcccatgtttaccacagcaccattcacaacagccaagatagggaatcagcgtagatgtccatcaacagatgagcagataggtaaagaaaaggtggtatctacacacagtagaatactattcagccatgaaaaggaatacaatcctctgactggcagcaacatggatgaaactggaggacattatgttaggtgaaataagccaggaaaagaacattaaacagcacttgtgcttactcatacatgaaagctaaaaaaaagctgatctcctgaaaggataaagaagaacagaggatactagacgctgggaagggaagaagtgagagatagggagaggtttgttaaaggatacaaaattacaagcagataggaggaatatgttccagtgttctatagtcttgtagggtgactataattagcaataacatgtcgtattgtttcaaatacatagaggatattgaatgttcctaacacaaagaaatggtaaataattgaaatggatatgctaattaccctgatctgattactccattctttgtatcaaagcatcactgtctaccccatgaatatgtacaattattatgtgtcaatttaaaaaataaaataagcctgggaaatatggcaaaacccagtcttaaaaaaatatatattagctgagtgtggtggtgcatatgtgtggtcccagctacttgggaggctgaggggggaggatcgcttgagcacaggaggtcaaggctgcagtgagctgtgatcacaccaccacactccagcctgggtgacagagtgagaccttgtctcaaaataaaataaaatataaaataggctggatgctgtgggtcatgcctgcaatcccaacactttgagaggctgaggcaggcaggtcactttaggtcaggagttccagaccagcctggccaacatggtgaaacccgtctctactaaaaatacaaaaattagctgggcatggtccccggtgcttgtaatctcagctactcaggaggctgggccaggagaattgcttgaacctgagaggcagaggttgcagtgagctgagatcgtgccactgcactccagcctgggtgacagagagagatggagtacataaatgaaatgaaatataaaataattgttaaaataaagtttacagtggtgaatacgccactatggccaagaacaggacacctttctcgaggcttccttcactctacagcacgagcaatacctgattatgtccagcccggtactgagcctgcttgcacggcactataaggcatcctcaataaactgcaagtgaatgtcagtgaactactttttttttttgagacagggtcttgctctgttgcccccaggctggagtactgcagcgtgatcctggctcagtgcactcagccttcacctccagggctcaagctatgctcctacttcagcctcctgagcagctggggctacaggtctgcaccaccacgccagggttttgttttttttttttttttaatttttggtagagacaaggtctcactatgttgcccaggctggtctcaaacgcttgggctcaagtgatcctcccacttcagccttccaaagtaatgggactacagatgtgagccaccacacccattactgaatttctttatattcctcattcatggaacagtatgtggcacacaacaggtgctcaataaatgtgtacaggccaaatgaaagagcctgagatatcatatttttcttttgttttgagacagggtttgactctgtcacccaggctggagtgcagtggtgcaatcatagctcactgtagccttgacctcccccaggaggccatcctcccacctcaggctcccatgtagcggggaccacaggtgtgtgccaccatgtctggctaattttttgactttctatagggatgcggtctcactatgtgactactttttaaggtgcaggagcagagtctgtacttgtaactgagactgggtagtctgcaaagctgaccgaagctctttgccccaagaaaaccatttcttgacccctggagaccaggaaaaagacagaaatacatgcaaatacagccttgaaaatggtgcatgtgtaaaaacaagattgtcatactatgctttgttgactgtagtaaaaagattacagtcctgctgcagaaaccagcagactttactaatacctagaaatgttcaaaatatgtgaaacaaactaaaaaaatatatatacttaaaactgcaaagaccaagataaatccaagaacatctagaagtcaactgtattagtccattttcagtctgctataaagaactacctgagactgggtaatttataaagaaaaaagatttaggccaggcgcggtggctcatgcctgtaatcccaacactttgggaggccaaggtgggcggatcacgaggtcaaggagatcgagaccatcctggctaacacagtgaaaccctgtctctaccaaaaatacaaaaaattagccaggcgtggtggcgggcgcctgtaatcccagccactcaggaggctgaggc[131 bp omitted]tcacagttccgcatggctggggaggcctcaggaaacttacaatcatggtggaaggcgaaggggaagcaaggcacatttacatggtggcagatgagtgaaagcgagcaaagggggaagtactacactttaaaaccatcagatctcctgagaactctatcatgagactgtactagggcaatgttgctaaactgtcagaaaccactcccatgatccaaccacctctcaccaggtcccacctccaacactggggattacatttaaacatgagatttgggtggggacacaaagccaaaccatttcatcaaccagtaagtgtatactagacacttacatgtccgtggcacaagttgtacttctgagattttctcatattgatcaggacagatactcatattggctcaaagtcatgttttccatttagcttcttttgacttaagatattctaattcaggtatgctagcaacggaaataccttataaaacggagctttcaaatgacaccctcattgattatcagaaatgtccatgagcaaaaataattctcctgtagattccaaatcacttcctgaccttaacaaaattcagtggagtggacggaatgagaggtccccaaaaagatacatccatgatcttaccccaacaacctgtgaatgggaccttattgggaaacagggttttcacagatagaattaaggagcttcagatgagatcatcctggaacagggtaggcccaaatccaatgacaggtatcctcataagagactcaagaggaggcacacacacagaggagaaggccacatggggacagaggcagagacagcagtgatgcggccacaagcccagggatgcctggagcccccaggagctgggagaggcagggagtatcctcccctagagcctccagagggaactggatacacgtgtagtggattgaactgtggccctcagaaagatctgtccacgtcctaatgcccagacctggaatgagaccttattcagcaatagggtctttgcagatgtgattaattgaaggatcttgagatgagatcgtcctggattaggatggccctaaatccaatgacaggtggccttccttctaagagactgaagaggagacagagacatagaggagaaggccacatgaaggtggaggcagagactgcagtgatgtggccacaagcccagggatgctggagcccccaggaactgggagaggcagaaaggatccttccctggagtacagtcctgagacactttgatctcaaacttctggtctcccggactaagagaggataaagttctcttgtttaaacctttcagtctgtggtagtttctaacagcagcgtcaggacattcatacgtagaactacacacatgaactgtccaatacactgcagtggagaaaaattcaaagaaaaacaaagaggagaaatatgaagtacaaaaatggaaatcaatgggagaggtgacagagaagtgggggtgggttacatgaggaaatgaaagttaccagagaaaggtaaatgattaggtgcgtgcgacgtggccctaacacagcatttcttccttcttaaataacatttcagttgcttgttttgcactttagcatgaaggtgagtttcccaatagggtatctctttgggccgctggtcctggagttacgagccaccacaacgtactgaaaaaccacccaggccaggctgggaagcagagctctgagtacagacactcatgcgatctgcgccaaccctgccgcctcagacgttaacaacctcccgagcccgtcctccctcacctgcccgcagcgttctctgtaacagtagttgggggagttgtattcctgtttctctctgggtttgggtggcgactcagctgtgtgaataatgcacaaatacaggaatggagcattaaactccaggaggaaatgtgccatacatacctaaaaacatttatggagaatattaaacgaagtgctcttggacagtagacattacataagatcatgggaaaggtattaataagcggaaaaagataaataataagtgagcactaactgatgatcttgcctgaaagaaaaagcagagacagtgtgtgtgtgtgtctgagaaacagcactcccccggacgcctgggcagtgccctctgaaaccctcaaatttctgtctctaaacatacagactgcttccaattcttaccaagtggagaataaattctcattatatggcatttggcattattaagcaagttaaattgatctgtggtgacagctacacttgcaaggacaatctgctaatcagcatgaatgcaagctccagattttcgcctgaaaaattcatgcccaggctaggcacagtggctcatgcctgtcatcccagcatttggggaggccaacgcgggaggactgcttgagcccaggagttcaagaccagcctggacaacacagtgagacctcgtctctacaaaaaatttaaaaattatctggacgtgctggtgtgtgcctgtgttcccagctacagcctctgcggtccccagctacagcctctgtagtcccaggaggctgaggcaggaggatcgcttgagcccaggaggtcgaggcttcagtaagctatgactgcaccactgcattccaatctggacacagaacaagaccctgtctcaaaagaaaaaaaaaaaaaacaaaaaaaacgctcatgcagtggctcacggctgtcatcccagcactttgggaggccgaggcaggtggatcacttgagcctaggaatttgaaatcagcctgggtaacatagcaagaccctatctctacaaaaaaattttaaaaaattagccaggtacagtgacgtgtacctgtcatcccagctactcaagaggcggaggtgggggtttgcttgagcccaggaggtccaggctgcagtgagctgtgactgcaccactgcactcctgactgggcaacagagcaaaactgtctgcaaaaacaaaaaaagaaaaatgaaaaaaatttacaccaattgtgccactagctctatcatttgccagtaaaatttgaatgtaaccattccgcctatttacatcttccagtaaagtggatggtgcaggcagagataccctgggcgctgtgagctgatgttctccctcctactcagctggaaaaacaccctcctaaactatcagctgacacactacctgctccagttctgaggaccggggctggccttggaagacaggtgctttggaaatgcattcaagaaaaggaaggcagaggtttttagagaaaagaagaaagccgtcactagaatttcactagaatttcatcccaccttgacttcttcctcaaaaatccttgtcccgataccttcagattaaaaactaaaatttaggccaggcgtggtggctcacacctgtaatctcagcactttgtgaggctgaggcaggttaatcactcgaggtcaggagtttgagagcaggctggccaacatggcgaaaccccatctctactaaaaatacaaaaattagccaggcacggtggcacgcacctgtaaccccagctactcggcaggctgaggcaggagaattgcttgaacccaggagacagaggttgcagtgagccgagatcgcgccactacactccagcctgggtgacagagcaggggtccctctaaagaaaaaaaataataataattaataaataaatataaaatctgtgctcctcagatgaatcagggaggctgaggtgggagatgagaaaggggaacttgagggccagttaaagcggaaggagcaggcactggggtgtgtgagggttggggcagagtagagggtgaaaatatagccccgggcacgttgacttgggcatcacagcagtggccctcaaagtggagtcccagggtggcttcccgacctcagtttagggatggctgagatcgtttttctgactccagttcagaatagtgatgaattttctcctatgcctcaactaaacaacgtgccacgcagcacagcagacaggctgcagacagagggaggagaggccagcagcccttgtgaaagctggacactaaagagattcacaaaacccagaaaatacagccaacctcctcacaaatgttttctctctttttagagacagggtctctctgtcacccaggctggagtgtagtgacgagaccacagctcaccgcagcgttgacctcccagcctcagtgatcctcccacctcagcctcccaaagtactgggaccctgggcgtgtaccatcatgctcagctaattggtttatttatttcattttattttttgtagaaatggggtctcactatgttgcccaggctggcctccaactcctgggctcaagtgatcctcccacctcagcctcctgaagtgctaggattacaggcgtgagccaccatgtccagcctgaatggttttaattctagaaagtgtggttacacatttttttcatttaaaaatgctatttatgttctcctctgattatttaacttctcatatatattatttatgtattctgttggtttatatttcagtctctactttaatttcaaatgtagtcagcgcggacagctgtaacacacagaaatgaaagttctgtgggttgttaataactttgagctgtgtgttgaagggttcccgaggccaacatgtttgagaaccactgcgcaatgcctaatgctccccgtggaagaggctccactgcagccaaattccaccttctctaggatcttctgcaccctgtctgctatgctgtattgtcttagttgacacctatgaagaaaattcatcactattcagatctgtcattggaaaaatgatctcactcatctgctgaaacacacttcgggaaccccatagtcctctgggatgccactttgagaatcactgctgtcacaactaagacaagatggcccaggggctttctcttaccctgcactctgctgtatgtcttgtgtgtccctgtgttttgttcttgatgctttagctgatttttttttttctttttctgagacagtgtcttgctctgttacccaagctgatgtgcactggtgcaatctcagctcactgcagcctcgacttcctgggctgaagcaatcctcccacctcagcctcctgagtagctgggactacaggaacatacaaccacacccagctagttttatttttattttttgtagagatggggtcccactatgttgcccaggctggtcttgaactcttgggcttaagcagttcttctgtctcagcctcccaaagtgctgggatgacaggcatgaaccaccacgtccagcctttacctgactcttgagttaaactctctgggagaataaaaccacagaaatggatgaggaaagagaataggatggaagaaatcggagctgagcttgggtccttggaaagtgcatgagtgattttgttccagaatgtgccacacaattttcatctgacctaaacatgtctcattccatgaaaataaaatctgcatcatgatatgatctccttcctaatcacatggcagattttaccaaatagatggttttccctgtgcttagtggaagattgagataatcacttaaagcaataacacagacaaggcacagtctcacttgatcctgctaagagtgggaatccagcaaatggagctgcgataggaaaggtgcagacacaggctgcgaagggagcaggaagactctgactgcaggccggctccacttgtatgtgcagcagtgccctccctccagccaccagaagtttctgggttcaaggaggtgaggagagcagcttgggagcattgctctcagaggcagtcaacacatacaaaatttagatggtttcagagctgctaatcagtataaagaaaacagatgggctggtcggacagggcatggcccaggagaacaggggaggccccagagggctgtgggagcaggtgacaggtgagcctgcagcatgtgcagtggaagagaaagggccagccctggctgggtgtggtggctcacgcctgtaaccccagcactttgggaggccgaagcaggtggatcacttgaggtcaggagtttgaggccagcctggccaatatggtgaaaccccctctctactaaaaatacaaaaattagctgggcgtggtggcgcacacctgtaatcccagctactcaggaggctgaggaaggagaattgcttgaacctgggaagcagaggttgcagtgaaccaagatttgcgccactgcagtccagcctgggtgacagagcgagacaagaaagcagaggttacagtgagccaagattgtgccactgcactccagcctgggtgacagagcgaggcggaacagaaaggaaaggaagaaggaaaggaaatgaaaggaaaggaaaggaaaaaggggaaaggggaaaagggaaaggggaaaggaagagggagaggggaaaggaaaaggaaaggaagaagggaagggaaagggaagggaggaaggagagagagagagagagggagggagagaggaaggaaggagagagggagggagggaggaaaggaaagggaaggaaaggaaagggaaaaagaaaagaaggaggaaggaagccagcctttgggcagggggacaggtcaggcttcctggcacgtttaaaaagcagtgggaagacaaggaggggccaggctgttgtctaagaggggtggacaacccacaggcagaccgtctcagaacctcatatgataacgagcctccgattctgctccagtcatccgggaagcaacaagcgggctcccagggaatagggacacagctgatgggtacgtggacaggatgcctgcagctgcttccaggaaaatgtactgcaggcaggaggggatgcaggagactgagaaggcttggggtggtccaggcgagctcaggccggctggagctggggaagagcacaggaatgcctgggagagttggggtcggcgaagctggtaactctcaaaacacccacccatgtgaagagacacagggctgctgagaaattgaaaaaacaatattcacccagaaatagactctaattagaaaaaaggaaaataaaaataggcttactgtgaatcaatagctccctgcctcatgaaatgcacaggtcagcagactgggctttgattgggagacggttattcatttaatttaattattcattttctttcttttttttttttttctttttgagatggagtctcacctctgttgcccaggctggagtgcagtggtgcgatctcggctcaccgcaacctacccgcctcctaggttcaagcgattctcgtgcctcagactcccgagtagctaggattacaggcaccatgcctggcttttttttgtatgtgtagtagagacggggttttaccattttggccaggctggtctcgaactcctgacctcaggtgatccaaccacctcggcctcccaaagtgttgggattacaggtgtgagccatggtgcctggcctaattattcattttcaattagcctaatgatttattacattacaattaggttattttctattctattgtattctaatatatttaaatattccaatgttatagcctattaacaattctggtaactttatataattcgaatacagtcattctaagagtgtaatattctattctttttaaatttatttttatgtatttttaacttcagcgtaccctgagactaatattgttttaactatagtctaatagttctatgttgtattctaacaatattatgtcctaatagtatattgtattctaataatagtctactctatcctagaatcaataaaatttggggcacacgaacctcactctatttaaaaccattagactacaggatacaacgatcctcaggcaatgctgccctcgtgtggtcagtgttatcaccgaaggaaaatgtggtgcttttccttgggtggacgctgatcaatatgcctaagttatttttaaccttttgggtttgcctaggacataatgggctagggtgcatattgagaagtttggttctatatgacttgtaggcatgtctcagcaaagagtaatggaaaattcaaaagaccaacaggccggtaggtaggtagattattgatagctagatagacagaaaggtagagatagagggataggtaggtaagtagatgattgataaatacatagatatatagaaaagcagatagatgaataggtagatagatgattgatagatggataggtagggaggtaaacagttacatagaaagacagatgataaatagatggataggcacatagataaataggaagtagatggatagattggtacatgaatgacagatagatgataggtaaatacatagataacaggtaggtaggcagataaaaagatcgtagagataaagagatggagagagatggatatataaatatataaatgacaacttagatgatagataaggataaatggataaacagatacatacatacttacaaaataggtagaccatagagatagacagggataggtgtgtgggtgggtgggtgggtggatggatggatggatggaagggtgggtggatggatggatggatgaaggggtgggtggatggatgaagcggtgggtgggcaggtgggtggatggatgaaggggtgggtgggtggatggatgaaggggtaggtgggtggatggatggatggatggatggatgaaggggtgggggggtcggggggtggatggatgaaggggtggggtggtagatggatgaaggggtgggggtggatggatgaaggggtggggtggtagatggatgaaggggtagaggggtgggggggtgggtgcatggatggatgaaggggtgggggtggatggatgaaggggtgggggggtggatggatgaaggggtagggggtgggggagtgggtacatggatggatgaaggagtgggtgggtggatggatgacggggtgggtgggtggatggatgaaggggttggggggtaggtgggtggatggatggaaaagtatataaacatagataaatagacaggtgggtagatggatggatggatgataaacaatacacatggatagctagacaatgaaatacaggtttttacgggttccactctcctcctgcggcatctcaggctccggttttgtggtggaattctttggtagtgcttgttcaacatcgttctgatccctaagctagtgtgggaattaacggattcactttctttataaaagagggcagagataagcacatgggacgatgacccctgtctgctccccaaacaaagtcagcgactgcctggatttcctgaggtggatgttagaatgtcacatgctccacacccccaggaacaagcgctcggtgctccccaccagcaggacctggcttagacacgccttccaggcaggagaatgcctctcttccttccctcctttgtttccaactgaaagggaaggttccccagtaaaactctggtctttaccccctgcagggaatcagagagatgtgagggaggatctggcttttgcgacaatggaggccactcagaggatacgctggtgtctgtctttgagactcaggggcaagcagaagaaagaaggaaacaggaaaagagagaacctaggaggcagagtgtcggctgtggcaaagcgcggcagaggctcccccaaccggtgttctgggccctcgctggctgggcttcctctcgtcttcatcccagagagaagagcctttcgtgcagagccacatggtgcaacagttcctctgacacgtagctcactccttcctacaggttcctatctggaaaagtgccacgctactgtgtcatcttagcactaacaacggaacgaggatgacgcccacgtcctgggtttccaagtgttgcgtgcttcctttgcgtttctggtctagtcatagtggagctgtctcaggcatatgctagacttgaacactcaatcatgctgacgtcccaacaaatgaccgacctctgttatgtggttgcagggtggatggcacctctcctgacttccaaatctcacccaacacaggtatcacaggcgttggaacgagagtaactccatcctgaacaggggccgggtaaaatgaggctgagacctactgggctgcactcccagacggttaaggcattctaagtcacaggacaagataggaggtcagcacaagatacaggtcacaaagaccctgctgataaaacagactgcagtaaagccggccaaatgccaccaaaaccaagatggcgacaagtgacctctgatcgtcttcatggctcattatacattaattataatgcattaggtactaaaagacactcccacaagggccatgacagtttacgaatgccatgacaaggtcaggatgttaccctgtatgctctaaaaaggggaggaaccctcagctccaggaattgcccaccactttcccggaaaactcacgaaaaatccaccccttgtttagcatatagtcaagaaataaccatcgaaatagccaaacagcagccctcagggctgctctgcctaaggagtaaccatacttttattcttttactttcttaataaacttgctttcactttatggactttccccaaattctttattgcgagagatccaagaaccctgtgctggggtgtgggtcgggacccctttcctgtaccacagacatacggttttaggaaagaacatattctcgccttccttgccagctgttcatccagaaaccactgaactgtatttggctgatttaccttgacccaacctgtgcccccctgagctctgcaggttacttcagaaagggtctgtgcagaagattcattttttaatttaatttttaaattctttttaagactaaacaagcgcagaagtgataaggggggaaaagagtagagcaaggagttcaatctgtagctgactgtgaaaatcaactgagataactcactaccttcagagcagcccagaatgttaattgtatatttaaagaagatatggatatttcaatataaaaatctcaatgggcatgcatgggtggttccttcacaagtttgggttttttgcctcttattcacacaagctcaattgctaattcacattgccaacctcagcagggcagcagatgtgtgtgcagccacactgtgtgtttgcgacactcacgtactgttttcaaggttacagaaatgccgagtggacgaatgggtgggggaagggggtgctggcctgtaagatgaagattctctacagagactctacttaccccgaaagcatctcgaatatcaggatgccgagggcccaccagtccacggcccttccgtggcccttgctctgaatgacttcgggggctaggtactcgggtgttccacagagggtccaagtcctatatgggcgacagagacaggcccccacaacactcagtggtgcttggctaatgcagtcaccttagaagctctgattgttacaataacttcgttgagtaaaaccacgctccgtttaccctcctgtgcacatattttaatgtgtaaagacagtaacattgttttcgctgattcctttccatagaaacatttcttaacgggcttggaagctaagaattggttttatcatccttgctcctgttgctggtactgttaccactgttactcagaagcaaaaaaaaacctcattttttttgagttatttataccttagtataaatcataaagaataaaattaattaattaaaggaaaaagaacgagatcatgtcctctgcagcaacatggacggaggtggagaggccattctcctaagtggactcacatgttctcacttgtatgtgggagctaaacactggggacacacagacacagagagggggaaaagcagacacctggccgctggaaggagaagcacaggagaaggatgaggatggaaaatctacctgtcaggtatgatgcttattacccaggtgacaaaataatcagtacaccaagtgtcatacagtttacccatgtaacaaacctgcacgtgtacccctgaacctaaaagttctttaaataaataaataaataaaattaagtaaaaagaaaatcctttatccaaaaaaaaaagtggcagtgaaaagaataattcaagaactcgcttaggccgggcatggtggctcacacctataatcccagcactttgagaagccaaggtgggcagattacttgaggccaggagttcaagaccagcctggccaacatggtgaaaccccatctctactaaaaatacaaaattagccaggcatggtgatgcatgcctatagtccaagctactccggaggctgaggcaggagaaatgtttgaacccaggaggcggaggttgcagtgagccaagaatgcgccactgcactttacactccaacctgggcgacagagtgagactctctctcaaaaaaaaaaaaaaaaaaaaaaaaaaggtgcaagagctgggtttgtacttgtaactgagactggatggtttgcaaagcttacgtatgttctctttggctctttacacccccaccccccaaaaaaacatttcttgccccctggaaaccagtgtaaagacagaaatacacttcctcccctgcataccattttcctttaaaggtgcctgctttgtgctccaaaagcaaaggggtggcctcaagcaggaagcctgtacttcttcccctaagaaagctctggaataaaaaatcactttctttacactagacctcgctcttgctaattgcactctgcaaacggcgagcggctgaacctgcattttggttacagaagaatctgctaaataaagtcagggcaagataacaaggactgcagcagaagctggaagactcatgggctggaaaggagctgagtatcagtaaccccagagagggggccttgtctgggccgtactccattggcgctctactgctgggtagaatgtcgcttcgggctttcagcaattcagacctgtagcacaaatgcgggccacatccacccttcctgccaagtgctgccctggtgtgtggagcctgtctgtagacaggcagaaagaagcaacaccctcagagggaaaaaatatatagatgctttgcaaaagacccttccctcccaccactcagatcaatgaaagaagaaacccttattttgtaagttgaatgtaaagagaacaaaaaacaagttccacagagtctggtaatatacatgtttatccactctcaagttctttgcacaatgtatcaagcatgtgcaaagcctattttatacccagcacatcttgcctgagtccgcactgtttgcagtggtgtgggcacgtatcttggcttcagctcctcagcttcctgcttgcaggaacccacccaaaatgttgttactgttatctttccttcccttccccaccacacctccataccccatctctttccagacaacagacttttccacactaatctgtaagcccttgggataacaacaaactggctgccatccaaatttcaaattctgtcggccatccatgaaataaaagtaccacaaggtcaggcatggtagttcacacctgtaatcctagtactttgggaggttgaggcaggaggattgctttaggctaggagtttcagaccagcttggacaacacagcaagaccactcctttacaaaaaaaaaaaaaaaaaaaaagccaggtgtgctgaagtgcacttgtagtctcagctagtcgggaggctgagatggaaggatcacttgagcccaggaggtcaacactgca[131 bp omitted]ggagagaaattgagttctcctcccatggaagcatgtggaagggacttactctctatctgcaggttagagctaagtatggaacagggaccaccttgtggtcctgttaagtgcttctcactcattagaattaagtctacaaatggaaagtacaatgcgcactattttagaaacacgctctcccctgccctgcccagcagttgaatcaactccaagtacaccctggctgcttcaatgcacgacacttctgtcattctgcaagacgagcgacttactggcctgctagttttgtatttccacctttctagcccatccaaagtggcctgaaagtagctaaaagcctagatcttagctgatatgaagcccaggtagaggccacaggtcatgctacaggcattagctgcaacttctccacttaccttttgaaagatgaggctctttttggctccgtgttagggtaaggacacacacctgaggttgtatgaggctgtataagtatccaggttctaacttgcctcaggaggactcctgccctgttagagtcactccttcctgcaaaaagccccaacgcctagctgaatgtacagagagacatacgctgctatggagagatgctgactgcgtgaatgaatatgagatgagacagcctgagtgttatgtcgagaccactggtctgggcagtgaattatccacttccctgctcctgtctccttttgctcacctggcttttgggtagaaggaaggtgacacctgctgttctcagttttctcactgttcttagtttcactatggccggggggaggggagggaggaggccatgttaacgaaggagaaacagagctaaggataggattatctataaagtatagatatccaatgactcctgtgttcttaatgcccacgccttccgccacacctgcactggttgaactgtgcaccccccaaagtcctaaaccccagtatttgtgagtgggaccttatgtgcaaacacgatctttgtagctgcaatcaagttaagatgagatcatcctggcttaggatggggaataattgcttaacagatacaagttctcttttgggatcgtgaaaatgttctggaactagagagaggtgatggttgcacgacatggtaaatgcaataaatgccactcaattgtgcacggcaagatggttcaaacaggctgggtacagtggctcatgcctataatctcaacgctttgggaggccaaggtgggaggatcacttgagcctcagagttccagaccagccaaggcaacatagcaagaccctgtctgtacaaaaatatttcaaagttagccagtcatggtggctcacacctctagtctcaagtactcaggaggctgagggaggaggattgcttcagcccaggcattggaagctgcagtgagccatgatcgtaccactgcactccagcctggctgacagaggaagaccctattctgaaacataaaaaatgttaataaagatggttacgatggtacattttaagtgtattttaccacaataaaaagagaaaaagaggccaggcacggtggttcatgcctataatcccaacactttgggaggccgaggcaagtggatcatgaacaggagttcaagaccagcctggccaagatggtgaaaccctgtctctactaaaaactacaaaaatcagctgggcgcggtggcaggcacctgtaatcccagctactccggaggctgaggcaggagaatcacttgaacctgggtggcagaggttgcagtgagccgagatcgcaccactgcactccagcctgggcaacagagtgagactccgtctcaaaaaaaaagagagagagacagagagaaacggatgacatctccaagctgagtttcagtccagtccctcttacgtcctagcaggtggcgtcaccagcctcactttctgtctctcctcatggctttatgacatggtgagcatgtcactcagctaacaggggcatggtagggctcaggaggaaggacagctgattacagcttttacacttgattacagatacaaatgcattttttccctttttatcagaaaagtatgagccagtgttttgtctgggtttggtaatgcaggaaatagatgttcgctcagtactcatggtgaaaatactacattgccttttcttataggatcttgggttgcaataaagcagcagggtgtggggtttttcataaaaagggaagattttgtcatctttttttttatggggacacaatcacagttcctagaactgtctgatggggacaaacagttgagaatttcaggcccgtgaagggagaaggtgtgtgtttgcgagcatgggacagcttccgatggccagcccaggccctgggaggggtttcctcggtgacaatggctcctaggcaccactgatcagcagggagaagggtgcctgtcaccaacctcggcacagtaatacccacgtcctagtatgaactacagcaaaattaaaaggggctcaagggaaagtaacaacaccgactgcaaacagactcgacatctcaggccctccttgacttccgttaaatactcaaagtaagaagctaggggaaaaggtctaaagtaactagaaagacttttctggtgttatgaaatatatataaaacgattatgtatttataaatgtatatgtttaaatttgaacttataatctaaacactaaatgtgtaacacatactaatatataaatttaaattttaaaaataaatatatatttataaaattatatataaaactatggataataatgtataattatagctacatataactttctaaacatatttataccataatttatgagcacatataattatttggtagccatgtttataaaattaaatatgtaatattaaatataaaactgtatccatttattatatatttaattgtattaaattattttttaaatataattatgtttaactaaaaattacatatttaatatataattataattagaatatattagtatattaatatatacatacattgttatattagtaattaacacattacattaatatctttatgtattaaatttatatatgaatatactaaaatatttaatatattaaagagataaatatatttaaatatataaatttaatgtcggatatattatttatgtgtaaatattacaattatatagttatttataattatatacataattatgattttatatgtatgattttctaatgtggtaaaatacacacagcatagaattttccattttaagcatttttaattgtatagttcggtggtgggaagtccactgaccttcgtgttcaaccctccctaccgtccactgctggaacttcttcatcattccaaacagaaactccatcctcattaaacagcatcttccccttccctgcacctccccggcccctggcacccaccattctactttctgtccttatgatttggaagaatctagggccctcctacaagtagaatcacacgacatgagacctttttggtctggcttatttcgtccaatatcatgttttcaaggtttatcaacgcgtagaatgtgtcagaattatattccttttcaaggccaaataatattccactgcacagacagagctcctggccaattttaaccagttcacaaagcaaatggcctggctcaggggtgggcaaatattttctgtaaagagccagacggcaaatattttaggccttgtgaatcacatggtctctgttacaaatatccagctctgctacggtagctcaaaagcccccaagatgtgactgtgttccaataaaactttattaacagacacatagggggctggatttaacctatgcaaggctaatttttttgtttttgatgttttgtagagatgaggtcttgctatgttacccaggctgggttttttttttttaaatagttgtcagatgtgataatggcactgaagttcttttttaaagggagttatctgttaaagataggataaagtgcacctgctttaaaataactcaagaaacaaatgggcaaagagaaaaaaaacaaagtgacaaagctttgataacaatcgaagctgggtgatggggccataaggtttcaatgtgaattactctctctactcctgtgtgtgtgtgtgtgtgtgtgtgtgtgtgtgtgtgtgtgtgtgtgtgtgtgaaaggggtaagtagtaattttgaaagactaggttcaatgttatccctataaggctagaaataaaaatccagaggacagtaatcaatgtaacatctggatttaaaatgctacaacagaggaactaggaaagagctgttgcacctggcatggtggctcacggctaccatcctggcactttgggaggccgaggtggaaggattgcttgaggccaggagttcaagactatcctggccaacatagtgggaccctgtctcaaaagaaacacaaaaaaacacaaacaaacaaaaagctgtcgcagagaaataaaaaacaccaaaaacaaacaaaaaagagctgttgcagagaaagaaaaccatctgttatggtttaaagacagatgtataaaggttgagcatctttaatccaaatctgaaatcccaaatgctccaaaagtcaatacttttccagcaccgacatgaggctcacagcgcaaaggaaatcctcactggagcatcttggatttcagattttcaaattagggatgctcacaggtaagtgtaattcaaatattccacaatctgaaaaaaatctaaaatccaaaacaattctggtctgaagtatttcaggtaagggatgcttgtgttatgcatttgaattataaaatcaaattaaacacatcagtattttattttgaccatttcataaaaccagaaataattctagtttgccaccaaatcttttaggggagctatctagataacataaagtgtgtgtgcaaaatatttacaatacaaacgtaatattgctgttagaaaacaagagcctggtgaacgcaagtcacaaaagaacaccatctgaacatactgacaacctaggaaagtcagaaatcaagtcaccaagagcagtggtttaaaataagtagggtacaagtcatccagttaacagggttgctaggggaggggaggggaggggaggggaggggagggttagaggaggcgaggggaggggaggggaggatagaggaggggaggggaggcgaaggaatgggaggggagggaaggggaaggaatgggaggggagggaaggggaaagaatgggaggggagggaaggggaaggaatgggaggggaggggaggggaggaaggaagggagggaggggagggagaggaaaggagggagggagggagggagggaggaaggaaggaaggaagggagggagaggctgagtaccgtagctcccgcctgtaatcccaaaactttggggggccaaggttggaggactgcttcagtttaggagttcaagaccagccctggcaacatagtgaaaccccgtctctacaaaaaatccaaaaattagccaggcagggtgtgcaagcctgtagttgcagctacttgggaggctgagagacaggaggattgcttgagcctgcaagttcgaggctgtggtgagccatggttgcactactgcactccagcctgggtgacagagtgagaccctgtctcaaaaaagaaacaaaaaacaaagaaagaaattcatgtagtgagtagattacattacaacatgcttaagtatgtttttaccccatgctataagagaaaaatggcgggg[318 bp omitted]ctttctgggatatgttcaaaaatgttattcaaggccgggcacggtggctcacgcctgtaatcccaatgctttggaaggtcgcggcaggtggatcacttgaggccagctgttcaagaccagcctaggcaacatggtgaaaccaggtctctactaaaaatacaaaaattagccaggtgtggtggtacatgcctgtaatcccagctacttgggaggctgaaatgggaggatcgcttgagcccaggaggccaaggttgcagtgagccaagatcccaccactgcactccagcctgagtgacagagtaagaccctgtctttaaaaaaaaaaaaaaaaaaaaaaaaaaattattcaagatgaggcctccctgtttagttccatctattctgtagtggtccacgatacagtggtgaatttcagttttattcaaaaggcacaggtactgtttgaatcctgaatcagaggcagggccatgtatctgcccccatgaacacaacttccctggggccgggccagcagagagatgcttcgttacaatgatggtcaaaaaaaaaaaggagaaaaaagcccccacaaaaaaaaagtttccagaagctacactacccatacagaggaagatgcagttctttgcaaaagcaatctatcaatatggtaatgagacattttctaagattttcacatgttcattaagtaaaataattgctgcatgttatatacgaaaccattttcgtccatttaaatagatatgatgaattaactggacagtaacatggtttgtcaaacttataaacaagtgaatatatgaaatattttatctgttttctttgaattagacttgcaaataaaatgactttaaaagaatttactaatataccgtgtgctgccaagagagggcagcacagatgctataaatcaatattttaaaaaatcctgcatctttcctactccatgtaaaatgcacctaatttccatgtgccttatttttggaaatgtagtacaagaaatactataggggaaaatcagattgaatgtaaacgcatcataaaattttcctaggagagcccttttctaaaagctgccagagaagagagtcatttagtgtaaaactgcccccacatcaagtttctcaaaatgcagacggttttacaatgttaggagtataattagtgtaattatcaccttacccaaccccaccacatcaaagaatatggaaatataaaatgtattttctaggcttgtctgaccaagacagaagccgatagccatgtgcaatcctgggtatttgaaatgtagcttgtctaccaaggaacggatgtcattatctaattctactttcattaatttaatctaattgaaaaactgacactcagtgtagttaccaaaaatctttctgagtatttttcagcagcttgggcgtgtgaatttactttttatgactgttgattttatgaatgtaaattaaagatccattgggagctaagctatgaggacgctgaggcataagaaccatacaacggacttcaaggacttggggtaaagggtgggaggtgggtgagagataaaagactacatactggggccgggtgcggtggctcacacctgtaatcctagcactttgggatgccaaggtgggcgcatcacaaggtcaggagattgagaccatcctggctaacacagtgaaatcccgtctctactaaaaatacaaaaaattagccgggcgtggtggcgggcgcccgtagtcccagctacttggggggctgaggcaggagaatggcgtgaactcgggaggcagagcttgcagtgagctgagatcatgccactatactccagcctgggcgacagagccagactccatctcaaaaaaaaaaaaaaaagttagctaggcctggtggcgggcacctgtaatcccagctacttgggaggctgaggcaggagaatcacttgaatctgggaggcggaggttgcagtgagccgagattgtgccactgcactccagcctggacgacagagcgagacttcgtcccaaaaaaaaacaaaaaaacaaacaaaaaaggataactgttttctcctcaatggagtatgtgtgtgtacggaaacatatctatatatacttgttccaggctgaaatgtatcccttaaaccttatatgctgcagtcctaacccccagaacttcagaatgtgactatatgggaaagagcatctttaaagaggtcattaaggtaaaacgaggtcactagggtgggtcctgatccaagaggactggtgtcctcataagaagaggagatgaggatacagacatgcacagaggacaatcctgtgaggacacagggaggagacagcgtctccaagccaaggagagaggcttcaggaggaaccagccctgcccacacctggatctcagaccttagcctccatgacagtgagaggaaaaggtctattctttaaaatgcccagtgtgtggtcttttgtcaagacagactggttaaatgaatccaatcatggaaaaaaaaatacatatacatgtattataagctgaatgtatgtgccccccgccaaaattcctatgttgaaatcatcatccccaaagtgataggattaggaggtggggcctttgggaggtgatgaggtcacgaaggtggagtctcatgaatgggatgagtgcccttacaaaaggggccccagagagccccctcgccccttccaccatgtgaggacacagcgagaaggcgccgtctacgaaccaggaagctggttccctccaggtacagaatctgtcgcacctcgatctcggacttccagcctccagagctgtgagccatgaatgtctgctgttgaggctgcccagtctatgagtgtgtgttagtgcagcccgcactggctgagacgacatgtaatggtttgtttcatgtgttgatgggccgtggggtgcccagatgtttgttcaaacactgttttggggtatgtctgtgtgtttccagaaaagaaacacatatatcatacatgtcatatagtatgatataggtatactatatatattatatactatgtaatatatatattatatataatatactatgtaatatatatattatatataatatactatgtgatatatataatatatataatatactatgtgatatatataatatatataatatactatgtgatatatataatatatataatatactatgtgatatatataatatatattatatactatgtgatatatataatatatattatatactatgtgatatatatattatatattatatactatgtgatatatatattatatattatatactatgtgatatatatattatatatattatatactatgtgatatatataatatatattatatactatgtgatatatataatatatattatatactatgtgatatatatattatatatattatatactatgtgatatatactatatatattatatactatgtaatatatatattatatatattatatagtataatatactatataatatatatatgtagtatgtgtaatatataatacgtataatatatactatatagagtatagtgatatgtatgatatagtatgatataggtatgctatataatatatattatatattataatatatagtatacctatatgatactatatcatagtcattgtatactatataatatatagtataatatatactatacatatataatactatatcatatgtacataaaatatactatatgttatatacaataatatagtattatatatatttctatttaatatacatatatagtggaaatatatatatacataatagaaatacagataacagaaaaaaataagtgcacgtgtgtgtgagcaggtgtgtatggaatattcaatttggttttttttttttttttttttgttttgtttttttttgagataggatcttgctcttttacccaggctggagtgcagtggtataatcacagctcactgcagcctcaacttccggggctcaaataatcctccaacctcagcctcctaagtagctgggactacagggatccaccaccataatcaacttttttttaaatatatatatttctgtagagacggggtctcactaggttgtccacagtggtctcaaactcctgggctcaaatgattctcccacctcggcgtcccaaagtgctgggattacaggtgtgagccacagcacctggcatttaattttaagagatattgtatcctattcgatgcagatctattttatagtcagggcaattcaaacttggatatgactcatttcctcatcatttcggatcaatagcggatatgtggtgttctgatttcctccacggtgccagtgaaggagactgacttcctgcccactggctctttgccagcaatcgcagcccacctaaaacgagctgtgggtcaacctggctctctcatccctggttgcaagtgtctcctacacatgagagttaaactctggttcccaatctttccctgcctgacctgccacaactaccaccacctttctcattgccaagcagtgtagattccatcggagttcacgttcctcttacctgtctaccagcttcttggcgaacccaaagtccgtgagcttaatgtggccatccctatccagcaggatgttctctggcttcaagtccctgtagacgatctctttggagtgcaggtactcgatggcacagatgatctctgcagagtagaagagccccgtggtgctggagaagcgcccccggttgcgcaggtagctgaagagctcgccgcccggcacgtactccatgagcatgtagaggaagcgctcgtcatgccacgtccagaacctgcggggacagacagcacatgctcagggccccgccaaggcagggcagggggtacgccgtcagctaggtgttggggtacagatgcagctagataccaaaatgtgtgtacagacagacagtaatagctggggacagatgtcgggacatggagcacacagatatcagcacatgggtaaagacggatgttaatatatgggtacagataggtgttcgaatgcacgtacatacagatgttacgatgtgcttagagacagatgttaggatatgggtgtacatcggggctgatacatgggtgtaaacagtgttaccatatggtattaaatatggatatagatatatgttagcatataggtatagaaagatgttaatatgtagttatagatagatgttaggatatggttgcagacagatattacaatatggatatggataagtgttggaatacaggtgtagacagatgttaatatgtaggtatagagagatgttaggatatgggtgtagatggatgtagacaggtattaatatatgggtgtagatggatgtagacaggtgttagtatatgggtgcagatggatgttagattatgggtgtagacaggtgttaatgtatgggcatagacaaataaaatacagatagataaatgttggaatataggtgtagacagatgttaatatgtaggtatagatgttaggatatggatgtaggcagacgttagaatatggatagagatcaatgttacaatataggtgaagacagatgatatctatacgtatagatgttacaatatgggtgtagatggatgtcaggatacgggtgtagacagaggttaatatatggacatagatgttagaatatgggtgtagagagatgttaacatataggaagagacagatgttacaatatgggtgtagatggatagtaggatatgggtgtagagagatgttaatatacacgtaaagacagatgttagaatatgaacgtagatagatattaacagaggtatagagagatgttaggatatgggtatagacgtgtagaccggtgttgctctgtgggtgcagacagatattaggatatgggtggaagtagatgttaatatgtaggtgtagatagatgctaatatatgtgatagacagatgctaaggtgtgcatacagacagatgttaggatatgcgtgtgtgtagatgtgactctacaggtatagacaggtgctgaggtctgcatatagaaaggtgtaattcatcagtataggtagatgctaagacgtgtgtagatgttaagaggtgtataatcagatactgggataagcatatagatggacattaaagtacaagttccacagatgttacatagatgttgtcttagtccattctggctgctatcacaaaaataccatatactagggggtcttacaaataagaaaaatgtattaccctcagttctggaggctggaagtccgaggtcggggcgcctgctgatgaactgcgtggtaagggcccattcctgagggaagggcccttctcgctgtcctcccatggaccaaggggaaacgggctccctcaggccccttcaccgagggcactggtcctgttcagcggcttcaccctcacgatctaatcacttcccccaaagctccaccttttaattccatagctttgggggttactgtctcaatatatgaatttggaaaggacgtattcagacaacagcagatgttaagatatgtgtatcctgggacatgggtaaaaggtctcattgtcttgggatgaatgaatagtaaatatcatggtctcataataaaccagccaacagtatgctatgggctgaactgtgtccttccaatatccactgtatttggagacaggtcatgtaaacaggtgattacggtaaaatgtggtcactagaatgggccctattccaacaggactggagtcctaagaagaggagatgaggacacagacacacacagagggacgaccacgtgaggacacagggagaagacagcgtctgcaagccaaggagagagggctcaggaggcaccagccctgttaagacgttcttctcaaaattctagcctcaaaaattataaaacaataaatcagtgttgtttaatccacaccgtctatgctactttgttatggcagcactaactaactaacctacaacacacacatcttcagagatcacacctgattcagtaacctggaactatcattaagcctgagaattaacaataaactagcagactgcatcccaaacctgctaggaaaaggtagcccttttaaaaagccccaaatgaagtatttcgaagcacttgcttgtgggagcttgcctgaggtgcttctccttacaaaggtgttgattaatggaagaaaacgcagcaatgagagattgaggaaggtgggggtagggatgaaagaaggaacagaagatactgaggtgcgtctgtgcattcaacatctcagcacaagttacaaatacagtttggagagatacgcactgataatgaaagaacgttttcacctaaagatgggacgggtggggtatgaggcaagatttggaactaagggctttgggatttttgtttgtttgtttttcagagagttttgctcttgttgcccaggctggagtgcaacggtgcaatctcggctcactgcaacctccgcctcctgggtgcaagcgattctcctgcctcagcctcccaagtagttgggattataggcgcccaccaccacgcccagctaatttttgtatttttagtagagatggggcttcaccatgttggccaggccggtctcgaactcctgacctcaggcgatccacccgcctcggcctccagaaatgctgggattacaggcatgagccaccgtgcccggtctgtttgtttctgaaacaggttcttattctgtctgccaggctggagtgcagtggtgcaggtaaggctcatgcagcctcaacttcccgggctcgagcaatcctctcacctcagcctcccaagtagctaggactacaggtgcatgccaccatgcctggctaatttttatttactgttatttgtagagacagggtctcactgtgttgcccaggctggttttgaactccagggctccagcaatcctcccgcctcatcctcccgaagtgctgggattacaaacgtgagccactgtacctgacctgggctttgtttttggagaggactcggaagacaccagcatgcccgtgttcccatgagcacatgagccttcaccagtagaagacacccaatagaatcaggagcataaaggtcttcaaccatgaccaggacccgtgccagttttgtctcatctgatcatgatgctatcacagatgctcccctgcaagctcattcaaatgagctgcaccccgctggtatacaaagaaaacaaaatgaggcccaggaaaccttccctgaggacagggaaggatgctcaaggtcgaccggatggtcttgtctgctagcacaggccattccaccaaaacaatgtagaatgaaggcaaggacgtgggagacagcttgcaatgacacagagattaatgctaagaaaaatcataggctgggcacggcggctcaatgcctgtcattccagcactttgggaagccaaggcaggaggatcacttgaggccaggtgttggaaagcagcatgagcagcacagcaagatcccgtctctacaataaaagaatcagccaggcatggtggcatcccagcaattcgggaggctgaggtgggaagatcatttgagcccaggaattggaggctgcagtgagctatgatcacaacatcactgtactccaacctgggtgacagagcaagacctcatttctaaaaggaaaaaaaaaaaaaaatagacacatgctactgtgaattttaaatgaacatttatttgactaatcacaatgtttttatgtattagcaaaaatatgggcctcttataaaaaaggctcttacctaacgcacttttaaatttgcagattctgcaatgatgctggaggtgggggactaatgacccacacatacaggttgcaggaatgccttctgctctccaccttgctgctggattcctgcccctcagcagctgggtggctgaagggagctcaggaagctcagggttagacatttcttctgttttttttccttcagttactgaaggctgtgcacctgtgtcccacctctccattcacttcttatagctcagcaagttcaaaatgtgtggtcttgaggcataaagggaagcagggacactatatgaggaaggagaagtattttgttggagtggtgttttttttgtttttttttttgttttttttttttttgagacagtcttgctctgtcacccaggcttggagtgcaatggcacgatcttggctcactgcaacctccgcctcccgagttcaagtgattctcccgcctcagcctcccgagtagctgggattacaggcgcatgccaccatgaccggctacttttggtatgtagtggctgttttccagagcaatctgctggagttctaaaagacccagcacatacccacattccttccatcttatcactgacatctcgactcattttctcccagctaaatgccctgtttttctgctttgcaccgttattggttgggcaagagtgttcctctcagtaatatttcgtgattaagcacatggcatctcaaatgcatgacagtcaaactgtacttttgtggatgagcttagaagacaaccatgatttcatgatttcactgttctggtggggaaatattttccaaggtccaaatactatcgtactagtgaacttttacaataaacttctgtgtcagctggtgactttctaaatttcttcagggcgcaaggtggaaggaaaatttagctacgactgaccagccaaggtgtgatactgaacatttgggggtaacactgagctcttgaaaataccattaatagtcaaagcaatagcaagaccactgtctacaactgttaatttggttgaagagaatatacatggctctacttccctatggctcaaatatgtaagaaaaagatggacgcatgcttacacacacacatacaaacacactctctctctctctatcaattagcttgcaacacatttttggatatatcctgtatcctcccccatctacctcactctgggataataatctgcacagatcctcttaagaataatgcatcaccttgtcacaatgtagcagcaggtcacctttcaggagcatcagagataattaaccatggtgggagattagaaggatttgggtaggttagaagcaaggaatgaaagaactttgaggattacacaggcatgtagaatacgcaagccctgacaatacaaacatctcaggttcggtcacttggcttgcaggggaagttgcaatttcaaccatgggtaggatgatctgtagaggaagagagttagggctttgtatcaaatgagaagaggagggaagggacgaggagaggaggggaaggaagaagaggtggggagaggaggagagaaagcaggggagaaaaagttactgcacgagtggggaaaactactgagatgtgtaaggttgtatgaaaatacatctgttccacaagtgtctcagtaaaatcaacatcaacaaaccacaaggcttaataaagtcaccttatcagtatatatgaaatggagacatcatttttacctatacactaatgcgggatcacccttcagcatctttaagaagtaacagtttacaaagagagttagcaagtaaaaacatactcctttaagaaaaagaaaaatctagataactgggattctcttgcccttccccaaaccaataagattaagtaaatattataagaaaaaagaagttctctgacacatccttccttcaaatcttttatcagtaagactttgcaggcgagtgtggtggctcacacctgtaatcccagcactttgggaaactgaggcaggaggatcacttgagaccaagagtttgagactagcctgggcaaaatagggagactctgtctctgcaaaaaataaaaagattagctaggtgtggttgtgcaggcctgtagtcccaggtacttaagaggctgaggcagcaggacagcctgagcccaggagttgaagctatgactgaacctctgcactccagcctcagtgacagagccagaccctatctggaaaaaaaaaaaaagactttgcttacgtggacagaatttgtacagagctgggtatcactaaagataaggaacaaaatgttgaaagagatactgactttactatctccaaaaaacattcacaaaacttaagtcatcatgtgcaggggctgtgggataggacgagtttagtgaccacaggtgatttcaaatctgagcttagaaaattagaaaccaatgcatcagttcaatgattccagttacctgagggactctgcccctgacatcaagtctataaaagttcaaaagcaatagaagataagagggtttatcacaatggatatgagaagtatgttcaagatctaacacttactgtacatactagcctcagcaatcaatgaattcatcaacacattaatcagtaactcaccagccacattctttattggtttccaaatgttttggacaagggccccttatgtgccaagtaatgttctcggtacatagtatcaggaacggcagatcttgtgactgtcatgagctttgcaggcttgatgtggaacagacattacatagtaaacttggaaggatggctggagggggtcctgtaagaccaggtagaaggtggggacagggaggcagggggcatctctgtccccacagctgaaggccaaaggaagattggggagagacacaaaagagctggaggccaggtgcggtggctcacgtctgtaattccggcactttgcggggccaaggtggcagatcgcttgagcccaggagctcaaaaccagcctaggcaacaaagcaagatcacgtctctacaaaaaattaaaaattagggcc[141 bp omitted]gtggcgggcgcctgtagtcccagctacttgggaggctgaggcaggagaatggcgtgaacctgggaggcggagcttgcagtgaaccaagatcacaccactgcactccagcctgggggacagagtgagactccatctcaaaaaaaaaaaaaaaaaaaaattaaaaattaggtgggcatggtgatatgcacctgtactcctatctacttgagagacagaggtagcagaatcacttgtgcccaggagttcaagatcagcctgggcaacatagcaagacccccaaaatttaaaaatcagccaggcttggtggtgcaggcctgtagtcccaactatctgggaggctgaggtgggaggataacttgggcccaggagaatgaggctgcagtgaactatgatggcaccactgcactccatcttgggcaacagagaaaggccctgtctttaaaaaaaaaaaaaaaaaaaaaattagagatggggtctcactaagatgcccaggttggtctcaaactcctggcctcaagcaatcctctcacctcagcctctgacagtgctgagattataggcatgagccactacgccctgcctattttcacatcagaaacgtttgggctgatacagcaggaaggggtgagttcagcagagatcagagatcagtggagagaaggggagggaatttagataagctatggcagcttctgtgaagacatcattgatgtggatgggctctggagatgtgtttgagaattggaaaggggcaaggcatggcggtgtgcacctataatcctagctacttaggaggctgaggcaggggaaatgcttgaaattatgagtttgagaccagcctgagcaacacagtgagatcttgtccctacacacacacacacacacacacacacacacacacacacacacaaaaaaattcaattagctggacatagtggtgtgcacttgtggtcccagctacttgggaggctgaggtgggaggatctcttgagcccaggaggtcaaggatgcagtgagccatgattgcaccactgcactccagcctggatgagacggcaagaccacatctcttaaaaaaaaaaaaaaaaaaaaaagttaaaagggcaggactcaggattacagtgaatgcagagtcaaagaaaaggaataaaaaatggttcctgggtgagccccaagagctggaaggaccacctatgaaatggggaagtgcaaatgaggaactgattagggctgaggggcaaggaggaagagcaggaactcatttttggtgagaggcatctgagcagaaggctcagagagtggtcaagtgggcgcacacatgtagcttggcaggctgaaggggtgggctggcagcagcgcttgggaatcttgagaccagcaagacagcgaatgcaaatacagagaaagaggaatgagagggcagaggggctcctgtttcccactgtggggtccaaggaaacgtcaccaggaagtacatgcccacaggcacacagccttgctcctagggtcacatgcaccctcccatcctctgcaacactgccttgcacagctgagctcctctcgaggagaagtgaggtcacctcccctgctgcacgcactggaagacctcctccgcaccagcagcgcatccatggcccctttcctccacttccacaccaacatctgttgttttcttacttttttgtttttttcctagatagggtctcgctctgttgttgcataggctggagtgcagtggcgcaaccatagatcactgcaaccttcaactcctgagctcgagcaattctcccacctcagcctcctgaagaactgtgactataggcgtgcaacaccatccctcgctatttcttcgagctttttgtagagacagggtctccctatattgcccaggctgttctaaaactcctgggctcaagcgatcctcctgcctgggtctctcaaagtgctgggattataggcgtgggccaccatgcctggatttttttgagtttttgtaacagccattccaatagatgactggataaagaaaatttagtatataaaagtcacagaaaatgtagtatatcgacaccaccataaaaaataaaatcatgtcttttgcaacgacagggatggaactggaaaccactatcctaagtaaaataactgagacacagaaagtcaaataccgcatagtctcactcaaaagtaggagctcaacagtgggtccacatggacacagaaatggaaataacagatacggggactcccaaaaggggaaggctgggaaggggttgagggctgagaaataacctattgggtacaatgttcactattcgggtaaggggtaccctagaagcccaaagctcaccataacatgatacatccatgtaccaaacgtccacgtgtatccctgaatgtctaaagattaacaacaacacaataataatacaacttctcctcctcaaaataccccagagggatctccaagaaaacaagagacaaaaatgatgcatactctagtggcatgaggccaaaactgcacggggcgcgcgcgtgtgtgtgtgtgcatgcatatatgtgtgcgtgcatgtgtgtgtgcacgtgcacgtgtgtgtgcttgtgtgtgtgcgtgcttgtgtgtgtgcgtttgtgtgagggggcttttttaacacaaagaaaagtacagaaggatccataccaggctgtgaaatagttacctggcaatgaggaattccagatcagcccagtcaacaaggtgaaaacccatatttactaaaagtacaaaattagctgggggtggtggtgcatgcctgtaatcccagctactcaggaggctgagttggaagaatcgcttgaacccaggaggcacaggttgcagtgacccaagatcacaacactgcactccagctggggtgacagagcgagactccatctctaaaaaataataataataaattaaaacaatgtattcaagcagctgaaatcaggcactggacagatatttgccaaaccttgttcatagcagcattattcactacagccaagaggtggaaggcaccccagtgtccaaggatgaatgaatgggtaaacacaacatgctgtatcctctatacgatggaatagtactcaggcttagaaaggagggaaattcctttctacaggacgggggaatctgaaggacattacagtaactgaaagaagccagtcgcaaaaggacaaatgccgtatgattctgcctatataaggctcctagaatcaccaaattcatagagcagagagtacgagggaggttgccagggcagggctggagggaggggcaataaggcgtgtttcatgaggacagagtttcagttggggaagatgaaaaggagttctggagatggatggggatggggatggggatggggtggcggttgcacagaaacatgaatgtgctccatgccactaaacagtgttttgttttttttgttttctgtttttttttttttgagacagagtcttactctgttgcccaggatagagtgcagcgacacaatctcagctcactgcaatctccgcctcc[140 bp omitted]ctcccaggttcatgccgttctcctgcctcagcctcccaagtagctgaggactacaggcacccgccaccacgcccagctaatttttttgtatttttagtagagacggggtct[142 bp omitted]catggacgctcatgcctgtaatctcagcactttgagaggccaaggcaggaggattgagtgagatcaggagtttgagaacagcctgggcaacaaagcaagatcacatgtttgccaaaaattaaaatattaactgggcatggtggcatgtgcctatagtcccagctcaacttgagagcctgaggtaggaggactgcttgagcctggtagttggagatcagcctgtgcaacacagcgagaccctgtctctaccaaaaattaaaaaattagccaggcgtggtagtgcgcacctgtagtcccagctacttgggaggctgaggcaggaggatcacctgagcccaggaggttgaggctgcagtgggccatgattgcaccagtacactgcagcctgggcaacagagcaagacctcatttcttttaaaaaaaaaaaaaaaaaaaaaggaagttaaaatagtaaactgttatgtgatatatgttaacaaaataaaaaaattaaattttaaagaatgttttccagcatagagagcaatctatgaatctatgaacggggggaaagtcaacatgaagaaagagtcaatgtcgtcaacaacgactgagacaagggaggtttccaagtcccctccccatcctctccagtgacctcagctgagcagctctgtcctcatctttagctgacagcagcacttttccatccgcgaagctgatctgcagtcttttatttgcagggtctgcggggatggcttgtcctctaagggatttttttgcttttgtttttgtttttatgaacaggcaaatcagcctcactaatttggagacgccttaccgtagaagttggtcctcctctctccagagcccgccataaagctgggcttttgtggtgagaagaagaaaatgagccatcctcatcccatctcctccaacatctatgccatgtgaggctccagaacggctctactttccgacctggctgcactgcaactagcccttaaccaaggtgacctagcagccctcggtggctccatccacctgtggcttcctccctccaaggaccctgcctcaggctctcttctgagacagttgctgcagatgttttgccctcaaagtttcccaaattggaatgcactctctctccctggatctcctcactgtccagcagcccaaatgcacagctgagccagagccagtccttccttatatgcacagccgagccagagccagtccttcctcataccccagtccccatggcagtctcctacacatctgggttcactgcattcctgtgtccacctcctggctgaactcagatttgagtttctcccccatgtccctcctgccccgtagtgacccatggcttccgtgtcactccctgtctagaatgagtttccaccacccacccctttcagccaataaacccctactcctcctgcaaaattctccttaggtgtccactgcgtcttcaccccctacctcttgccctccagagctggtaaggccccttttccacgtatcgctgggactcttctcaccctacgcagttctccttagaccaaggcactggaaggcttggcatcaaatggaaaactccattcagaagacactacagttgcattctcttgcaagaacttaaacctcccttttcatacatagaaaaagggaatcaaggtaaaaaataataaaaaagaaaaatatagataataaaataagcctccctttttgaagcgtctgctttgccccaaatactaaacatgcaatgtatcattttttggacaaagaagaggaagagaagacccaggagctgcctgccttcactctggtctctgtgctttgcaggcagtgatgacagagcaagaagcgctatttctagatttttgcctttaaaattcaaatagagagcaaaataaataaataaataaaaggagagaacatggtgttctttcttcctgaactctcagtaaaacaaaggaatgattttactcctacccccaacaagtaccaatgacaatggggaccacactcaagtctgcagactttaaaaaaagatgtttccaagagatgcatccactctccccgaagaagaggttctggcatgaactcctctccatggagaaacgagcggtcatccaggaactagaaggatgtggcccggagtggagagacctcttgccttccaagttctgtagaagaaagctggctaagccctgcaaccacagaccaaacccactggcttggctcggctgctgtgccatagataatatggcactggaaccactgtttggcccataagccaatcaatcatgacagaagagtggggctgcaggctcaggggctggggcagaaaagggagaaagggactccacacgcacaggtatttatctgtctgtgcatccgctacagtgggtgtcaatggagctgattctgctccccacaataaacactggacaatgtctggagacatctttggctgtcacgctggagtgggggtgctagaggcatctggtgggtggagcccagagacattgctcagcaccctacagtgcacagggcggttccaccgcagagaatcctccagccccaaatgtcagcagtgctgaggttgagaaactctactaatacgttccatcatcaatctatcaatcaatcacctatctatctcaatatctatcaaccatctaccatctatagctaccagctatctatcaatcagctatcatctatagctatcatctatcaatcacttatctaatatctatcaaccatctatcatctatagctatcatctacctcaatatctgtcatctatcaaatatctgtctcaatgttgatctccatccatccatccatccatccatccatccatccatccatccatccatcaactatctgtcacagtggttcacaactggggataactttttgtccccccatagggggaacttagcagtatctagagacatctttagatactcgtcatagatgggatgggtgctcttggcatctgctgggtggagtccagggacgctgctcaacaccctacagtgcacaggatgccccaccacagagtcctccatgatcccgccccatgtgtcagcactgctgaggttgagaaactctcttttagcatgagagctctgcctacatgcaatcggtcattaatctatcaatcaatcacctacccacctcaatatcatctatcatctatagctgtatatattagtatctattatctatcacctatcttaatatcatctattagctacccatcatctatctactcacctatcaatcacccatcatttacacctatcttaatatctattatctatcacctatccatctcaacatatacctacctatcgtatctatcatctctctctgtccgtcgtctgtctatcacagtggttcactagtggagaaaactttgccctccctccctgaaggaacacttggttatgtatggagacatttctgcttttcataactgaggttgctgctcctggccgctggtgggtggagcccagggacactccccaacaccctgaagtgtgcaggacggccccaccccagagactcctccagccataaatgggaggcacctccgctgaaagtcctcgttttataccttcatcaagaagtccaaggcctaaaactgcccgtatgggaagcagatgttgagcaaggcaacttacatttagaagagaagctgcacagctgggaggatgaaattcattcttcacagaggatctaggattctcctctaagacatgctcctcagcatgcaacgttggacaccctccagcatcttatccatggggctggccagacccggcgtgctctctcgtgttatgtacagggaatgccaagtgtctgaatgcactggatcaactttaatccagttcttaaagccacttggtccctaaagtgttaatgcacagaaaaagcaaaatgctatagcaggttatcataatactgcagggcaccgaaagatcaattatcagcaagtcactaaggcggtctcatgggctaagttacatcaccccctccaagtctacattgtttttcggattcttttttgagacagggtcttgctctgtcccccaggctggagtgcagtggcacaatctcggctcactgcaatctccgcctcccaggatcaagcgatccccctacctcagcctcctgagtagcagggactacaggcccccccaccacacccagctaatttttgtactttttgtagagacagggtcttgccatgttgcccaggctggtctcaaactcctgggtgcaagggacactcccacctcagcttcctaaaatgctgggattataagtgtgagtcaacatgcccaagtggcaaactcattttctgtcattttttgggaaaagtcacctgtaaattgctatcaccattaagtctttaaaggctcattgttgacaatcacttccctagatccaaaacttttcatgagagctgtggacttcagggcctgccttgttttctgcactatttcaaaatcaaagaactgtatttatttatttatttttatttattattattttttgagacaaagtcttgctctgtcacccaggctgcagtgcagtggcacgatcttggctcactgcaagctctgcctcccaggctcaagagattctagtgccccagcctcccaagtagctgggttatagacgtgcgccaccacgcccagctaatttttgtatttttagtagagacagggtttccccatattggccaggctagaattttctttttaattttttttcttaagagacgagatctcactatgttgcccaggctggtctggaactcctggtctcaagtgatccttccgccttggcctccaaaaatgcagggattacaggtgtgagccaccgagctcggccccaaatcagagaattctgaaatgagcccctgccatgttctcccaaaacactgaataaaatcctcccaagaataatatcgaaagtggccttaaattccatgtagactttaaatgatgaggaaaaattcatgctttttggcaacaccaccaggcggacctgacatacaaataacagctcacattcgactgtaaccagcactcggaggagccggtgagctgtacgggcaaaggacaacccatgaagcatccaaaatgtcctcttcaaaagctgtcacggtgcagagaaatttcactccttaaaagttagaaataggccaggcacggtggctcacatctataatctcagcatgttgggaggccgaggtgggaagatcatttgagcccaggagtttgagactagcctgggcagcaaagtaagatcccatctctacagaaaattttaaaatgaggtaggtgtggtggtgcacacctgtaatcccagcatgtcaggaggccaaggcaagtggattgcttgcagcctaaagttcaagaccagcctgggcaacatagcaagaccctgttcatagagaaaaaacaaaaacattatcttcaccaaagaggttgtgaaaaatatatacatatgttttttaaaaattaaaaataaataaaaacattagcagggtgtagtgatgggtgcctgtagtcccggctactctggaggctgaggaaggaggatggcttaagcccgggaggttggggccgcagtgagctgtgattgcaccattgcactccaagatgggccacagagcaaaacccgtctctaaatgtaaatctatatatatacttttttatataaaagataaaaataaaccaacataggtaactttgaatagaatttctaaagtctctagggctttatataagacttaagaaatataaacgactttgttccttaattgaaagcagggaatatcaaaatcagaatccacgtccctgcaggaatgcaccttatctgccaaggaaaacagtcttgagctatcctgccttgaagaaaggagaactacctaactaaagctctgttctacaagctcctccctattttttaacttgcgggagctcaagaattccatcctggggaattctctcacttgtatactccacccactcccatgtccatgcggttcttctgtgggattttagatttctgaactgtagagtactcaggagcccatcgtctcggctgctctcctgctccaggaggcgcagggggtgtgtgtgagttcctcagggctatcattaacaaagtaccacaaactgggggttggggtggagggacgcggcagacaacagacatgcattctcagtccaggtgcaggggctgacacctgcaatcccagcactttgggaggctgaggctggaggactgcttcaggccaggagtttgagaccagcctgggcaacacagcaagacttcatcctacaaaaacttttaaaagttggtcaggcatggtggcatatacctgtagtctcaactagttgggaggcggcagaggctgcagtgggccatgattgtgccactgaattccagcctgggcaagaaggagtgagaccctgtcaagaaagaaagagaaatgcagaaaggaagaaaggaagggaggaagggagccaccgcgcccatcctctgcatatgattttgttcggagcttaggcagcattgggtctagaggagaaggcaggtgcacttgttccagtacacacgaggtgcttcaagaacatgatgggaggcaccctgtgtcccggggacagcaggtgaatgagggaaaacaggtaggtgtttcttagatgggggaagtgaaggacaatgatgagagcaaagaaggaggcctgtcaaagaagggtggcctgggagaagccccggaatgagtgtgtgaacagcaccttctaccttctcctgtagggaggtggtggcagggggccagtccacgaggatactggtaggaggatgctgcattgctggggctttatatgggatacttcaggagtaccctgaggatgaaaggagagaggcaggtcattgcagaggtacctgggaggaccagtgaggctataaagtgaggaatgtcttcaaggggagcaaggctgggagagaaagaccaggtaggagggaagccagtacagaaaatcagggcagagagacgggacccagataaagcagaagatggataggtggacaggagaggcatggtagcaagatggcggagggaagacgtgggaattggatggaaggcacccatggagggaaaggagagacacgcaggacatccttgtctaaggcatctgggtggaaatggaattaccctgctggaatggtctgaatatcttgtgtcctcccaaatccctatgttggatcctcacccccaaggtgatggtgttaggtgttgtgtcctttgggaggtcatgagggtgaagtctcatgaatgggacgagtgcccttataaaagggaccccagagagatccctcaccccttccaccatgtgaggacacagtgaaaaggcgccatctatgaaccaggaagcgggtcctcgccagacactgaatccaccgtgtcttgatcttggactttccagcctccagaaccatgaggcaaatgtctgtcatttgtaaattaccgagtctaggatcctttgttatagcagcctgaatggactatcacacctaccctaggacataagactgttgtgtaccatcagctggaagtgtgtgggctgcatctcaacggggtatctctcatccacagtcaaccagaaacccaacgaaacctgaagcccagccccgtccacgtgactgtggtcccttaaaaaccaacttaaccagttctgccgagagctatagatgcagaacccaaggaggtgaggagacaaagatttctgcatccttttccgggcagagatacttggttcacccaggagaggagcaaggggccttgggcacggacttctgaacacagagcgtttctttttggacctggtcagccatggaggtcaggagccctggaggtattccagctctaagatcagaggctgataagacctgacaggtggagactgctgtggcctaaggctttgcacgcaggccatggtctcggcccacccagcttcttataagaagagacacacaggggtctagggagagtgcgtggggagaggcttcaggaggggactcacagcctgatgaggaacgggtggctgacttccttcaggacagacttctcattgtgtacgtgttgctcctgctttaggcggatgacgtcgggaatgctcatcaccttgagggcgaagaaatgcttggctgtcttctccttcaccaggtgcacccgcccgaacgtcccagtgcctggagagagaagaaatcgacagaggtcattaagtcttccgacaaaggaagaaaccaccacagccatgcaatcagcggggggctgcaccaggacggcaaacacagaccccaagtgaaactttcagagactttgtgtcatggtgcacgtgggctgatggcatttagtgagaggcgctcacctggaattttccactgaatacagaaattgcagagagagaaagagggagagagagggagacagagagagccatctgcctctgaatggttcctcaatttggggacaaactggccataatttctgcagatcagtcttcgcacacagcacacccacacgccccacacacccacatggagaagcattagagtaatagtaaatgtatttatataacatgcctttttctcttcaggctctctggttttatcagaaatacagacagggtgtaaaacacacagccctcctcaacacggctgtttccttaacgcacattaaggcttgctcaaagtacggagtccgtattctacaatctggcgtgggttgggatgaagtgctatataggtgcccacaaacagaaaacaaaacaacaacaacaactgcaaccactacaaatataaaagaaaaccaatagctctactgtattctgctgggacattttcaatccaaacactctcttctcctccttcccctcctccatctcttccttctcttttttctcttcctcaatcttctcctccttctctttcatctcttccttctcctctacatccttttcttttccacttcttcctcctcctccatctcctcctcctctccctcctcttcctcccactggggtgcatgtaaatgaagaaatctaatagtcaatgagatataaaagaaaatcaaaatctctaaacaagctttgcttgttcctcctcctcctttctcctcctccctctcctcttcttcctcttcatcctcctcctcttcctgtaacacactgatcctacaaggtgtgcacgtgttcacgcacatattgaaatattcttcacgtagcataaatgttcttgggttaatggaacgaatagtgcagtggcgccatcacagctcactgtagcctctacctcctgggctcaagcaatcttcccgcctcagcctacccagttaatttttgtactttttgtaaagagggggtcacactgcgttgctcaggctagccttgaactcctgggctcaagtgatcctcctgcttcggcctcccaaagtgctgggactacaggcatgagccactgcaactgatgcaggatttctagagtatccctaaattgcctttgacgtaccttgatcccagcgtcagcagccccttactgacatgcaagtcattcctcagcaatatttttaaacaacgcattcacagctgcagacagagatgagcaactaaaacaaaactgccctcccgtattatgtgatcacacccaccccaaacagcagagaggcttctcagaaactgacattcagagaaaggatggtttggaagtgtatccttctgaggaaccaacatctgttgacgagcaaatctcaccgatcaatattgatccatttacctatccattcattggctggtactcctgtgcctgctttatgctagattgcaaaacccaagagaaccaggatcttccagacacctgcactcccatgtttatgacagcactattcacaacagccaaggcgtggaaacaacctcagtgtccgtccaagggcaaatggataaagaaaacatggtacatatacacgatggaataccattcagccctaaaaaagaaggaaactctggcatttgcagcaacatggatggaactggaggccattatgttcagtgaaataagataggcacagaaaaacaaatattaaatattgcatgatctcacttatacaaggaatctgacatggcttggctgtgtccccacccaagtctaatcttgaagtgtggctcccataatccccacgtgttgtgggagagaccaggtgggaggtaactgaatcatgggggtgggttttcccatgctgtcctcctgatagtgaataagtctcacgagatcagatgttttaataaatgggagtttccctgctcgggctctcttcttgcctgctgtcatgtaagacgtgactttgctcctccttttaccttctgccatgactgtcggaacctccgcagccatgtggaactgtgagtccattaaacctctttcctttataaattaaccagtctcaggtatgtcttcattaacagcatgagaatggactaatgcagaatctacaatagtcaaactcatagaagcagagagtagagaggtagttatcagagggtagggcttgagggggaaggggaaatatattggtcaaaggatacaaagttttagttgaacaagataaaccatggagatctaccatacacctagttcatatagttaacaatactgaactgataaatgaaattttatatataaatagctcacatatacaatagtaaaattgtatatatgaaaatttgcttagagggtagatcacattatattgttttgtctttttttttttttttttttgagacagggtctctctctgttgcccaggctgaagtgcaatggcacaatcaatagctcactgcagccttgacctgccaggctcaagtgaccctcccacctcagcccaaatagttgggactacaggcgtgcaccaccaagggcggataattttttaaattgtgactgggtatttttgactggtttgagaaggaaaaaaaaagaccacaaccatacaatggatttccttccaagagtctggaatgccattgattgcacatggtaacgtgaaaagaaaaagttgtacttaagctaccaattttacttagagtatttgctgtaaactaaaatccccatgttgtaaaatatctaagctaatgaatgatgaatttactagcttatagggcagactgggaagggaggaggagaagtaacctttgctttttaagtgaagtttccgatactgaatattttattatggcagaaatagaaagtgaactacaagataaagaaaaagtgtaagaaggaaacaatgtcaatagctgacaggtgttaaatatttctttaaaaaaagtaaacaaataatgaaatagtaacacatttttaaagtatattctcttagttaatttggaaataaaataggttttattacagtacaacatggtgtggacaaaattaggtggaatcaggtcaaagacaggaagtgggagaagggctttgaggactgtgaactgatacagtttaggtgtttgactatggccactgatgtttcaattggataaaacacaattaggaatcaggaacactggcatccaacccaagcttatcctgccattggacctatgaaatgggcaacagagtaaccttttaaccttttagtctcctgttgctcttctttccaacagaacttgcatattattaggaaacattaaattcttgccacaccctaaaattctaataatgcaatgaatatggtccttgacttttcttcctctatctggttccttcctccttatttatctttctctatcacccaccccaaggaacccattcattacttggctgtgtttactgcataacattctgtcttagtacttgtatttgaccctcaacagagagaattctccatgcctactttaagaacaacagctatgactcaacagattttttacacttctgtgacttctttaaagctttctctgagctgtgtgcattataaacatacaaaactcaaaacacgttacttatgcactgcagcggatctttgcgctaccctgggagatattgtcagtcccgccaacgccacaatcagactgcagaagtatgtcggtaaacaaccttactcaaagcagacagaagtggcatgctgtaatgtttaaggtttatcagcttaagtgcacagaagacaaaggcaacatttaatggtgctggtagatcttccccgcttggtgttggaaggctctccagtacacattccccagttatcattatcccacttgaggagaaaatgtctatttgtagccttctctgcagctaagggtggccatctgacccagctttgcccaataagacataaaaaaagagtgttttcaagtgtttctaggcaggtcagctctttccttcctgataagggagatcttgaaggtaagtggtccattccccaccctagagatcccctccatctctctccaagctaagtagtagtgttatgcacgagggaaatcagatgtggagtttatgtcttttcttttaattttagattcagggggtccatgtgcaggttcattacatgggtatattgcatgatgctgaggtttcggcttctaatgatcccgttgcccaagtagtaaacagtttctaataggaagtttttcagtcttttccccactccctcccttcctctttttggaatccccagtgtttattgttcccatctttgtgtccatgaagtactcagtgtttagatcccacttataagtgagaacatgcaatatctggctctcgattttttgcatgaatttgtttaggatagcagcctccagctgcatccactttgctgcaaaggacacgattctgttcttttgcagggctgcaatgtggagattaaagtcaaagctttaaggggaaagcttaagtatgggttctacaatcccttacccacagtggctaaagctaaaggctctgaatactcaaagtgtcttcatcaacacacctggccgcaaaactggaccttgcctaacgtgagactgttcaggcttgatcctccttggggtgaatatctacctatttcactacagaaatattcttgtcttgataacaacatccagcccagactctgctgagggtgttgtataattaaaaaggacatgcacccattctcatcccaaatttagaaaaatccccaaattcccaaatatacctgatctatacatttcagagacttagaaggaccatggcaatctcgggaaggtgtggctacttttaaggtgggcacgccctttttatagcaggtgcaatacagtgggcttttcctccaacattcaaagagttgtttctccagccaagtgccagacgaggaaggtggatcagatttatgagccattctatgtgtgcaattctgatctgtaaacattaatgcggggtggactcaggtctcctctctcccactggagaacctcctgctttttgaaagcctctgacagtgtggccactctctctgcattccctcatccatctatccctcctcccctaccctatccatccttcccaagcccttgggtccaactcacacacaaacacatcctggcctgttgttgttgttgttgttgttgttgttgttgttacagagtctcactctgtcgcccaggctggagtgcaatggcgcaatctcagttcactgcaacctctgcctcctgggttcaagcgattctcctgcctcagcctccaaagtagctgggattaccggtgcccgccaccccgcctggctaatttttgtatttttagtagtgacagggtttcaccatgttggccaggctggtctcaaactcctgacctcaagtgatccacccacctcggcctcccaaagtgctaggagtacaggcatgagccactgcacctggccacatcccagctttctgtctggagggatgggaagaaggagaaagacgacctccacactcccaataaagagcaaacatcataaacttcaactttcccagaaaaatgccatgggcatcttctgagctccacccaaatacaggcatgtgtaactgtaaacatacacatacacattacggtcaccaaaaaatgacagcctttatcccgaatgtttagacaactcagcagaactaaaatattaggtgaatcaccatgaccatggaaaatgctgaaaggttcccttgttagtgaagactcacaactggcggcttgggggctggggggaatctacagccaggcaccgtagctcgcaactgtaatcccagcactttgggaggccaaggcaagaggatggcttcaggccaggagttctcgaccagcttgggcaacacagcgagagccccttgtctacaaaaacatagagatctcatccctattaaaagaaattagccaggagtcatgatgcactcctgcagtcccagctactggggaggctgaagtgggaggatcacttgagcccaggaggtggaggctgcagtgagctatggttgccaccgcactgcagtctgggcaacagaatgaaaccctgtctccaaaaataaataaataaaaaataaataaggccaggcacagtggtgcacacctgtaatcccagcacactggaaggctgaggtcagaggactgcttgagcccaggaattcccgaccagcctgggcaacatggtgagatccctatctctacgaaaaaatacaaaaattagccaggcatggttgtgtgcacctggagtcccaactgctcaagaggccgaagcaggaggattgcttgagcccaggaggttgagaccagccagggcaacatagtgagaccctgcctctatttagaaaagaaataggccgggcacagtagctcacacctgtaatcccagtgctttgggaggccaacatgggaggatcgcttgagcccaggagtttgagatcagcctggacaacacagtgagaccccagcctctactaaaaatacaaaaaaattagccaggcatggtggcgggtacctgtaatcccagctactccaaaggcatgagaatgtcttgaaccagggagcaggaggttgcagagagctgagattgcaccactgcactgcagcctgggcaacagagggagattttgtctcaaaaaaaaattttttttaaataataaatatatctctcttggttcaaaaatctaaagagaaataatttttttaaatgtacaaagcgaggtatgagaaagaacagaaaacacatttctcactgtgaaaagagatggccttttcctctcttcctcaagcccagcaaaccctaaatccctcttgcctgtgactttggagggaaggaaggaggcggccagcagagagagaagcaaagacagcaggccaccgtgtttatcatcacgatgcccattcatactaaagaagtgtccagaaagaggagaaacacggatttaagtttctttggttatatttttaaattttgctagaactcaaaacacttcaggagagctgtatggaataaacacagggaccgtgacatggaatttcacgcggtcacaaaacggaaaagaaaccaaccaaccctgagtactttcccttggggtccgtgggtatatgggatggggtcaggaaggtgacgggagaaggaccgtgtctcactgcagcacattcccgggagtagattcacggatgatctcagacaccaacagctgacaccatctgagcccagttcttcctctgtgctgcaagagcaacgccgcacagctagctcggcctttcacaggtcacctaaacacagccaatctcccctctccccactttgtgtgcattgaatggggtgccctggaaaagatacgttgacatcctaatccttggtacctgtgaatgggaccttagttgcaaacagggtctttgcagatgtgattaagatatacacaaaggctgggcacagtggctcacccctgtaatcccagcacaggagtttgagaccagcctgggcaacacagcaagacctcagctccacttttttaaaaaatgaaataaaaaaaaaggtatatattaaggtgaggtcatcctgaaggtggtgcaatatgagtggtgaactaataaggagacacagacgcagaggggaaggccacgtggagaaagaggcagagagtacagtgatgcggccacaagcccagggacacttggagcccccagcagctgggagaggcaggaaggagcttcccctggagcctccagaaacaactggatacaactgtagtggactgaactatggtctcccagaaagatatgtccatgtcctgacccacagaacctgtaaatgagacctcatttgggaaaagggtctttgcagatgtaattaagttaaagatctcaaggtgaggtcatccaaaattggagtggaccctaaacacaatgacgggtgttcctgtaagagaagaagagaagacacagacacagaggagaaggccatgtggagacggaggcagagaccgcagtgatgcggccacaagctcagggacgcctggagcccccaggagctgggagaggcaggaaggagcctcccctagagcccgcagagggagcacagccctgccgcatctgcacttcagagttgtggtctccaggactgtgaaacaattaacttctgttattttaaggcacccagtctgtggtatgttaccaaagcaaatatgcccaaggggtacaaattcaaccaaatagttccaaatttagccaagtacattccctagcaatgctgcgagctcacagtcaaaggtataactccaccatctctgagaacctgagagaggcttccagggtggtctgaactgtgcagacctcagcaaacagcaacatcccaggaaagagtggggctaagaagctactaatccctattcctacaaaggcagcctagacatgtctgagccttcccaggccgatcactaaggaatgtccacaacgcagagccgccccaaacatgggagaagacagaagtcttcaaaggagccgagatgaaaaaccaagttcaaattgtaaactaggctgggcagggtggctcacgcttgtaagtccagcactttgggaggcctagatggtgggatcacttgaggccgggagttcaagacctgcctgggcaacatagcgagatcccagctacaaaaataaaaataaaaaattacccaggtgtggtggtgcacagccgtcgtcccaactacttgggaggctgaggtgggaggattgcctgagcctgggaggtcgaggctgcagtgagctaagatcgcatcactgcactccagcctgggcaacagagcaagaccctgtctcaaaacaaaaaatgacaacaacaaaaacaaataggaaactaatggctgatattttagtcatctgtacataaatcccttcataatctttactgaggtaagaaccacattttcatccaaaaaaaacaaggtagttggccaggcacagtggctcacacctgtaatcccagcacttcgggaggc[134 bp omitted]tgagacaggagaatcgcttgaacccgggaggtggaggttacagtgagccaagattgcgccactgcactccagcctgggcaacagagcgagactccgtctcaaaaaaacaaaaacaaacaaacgaacaaaataaggtagttaagcaagaatttggtaggagtggtcacagggagagattactttctgggtctcaatctttccctctatcaagtgttggttatttcttttcatcagtacaaatattctgaggtgcataaagatctgacttaagcttcatctcattcagcttctgcagtattcgctactctctgttgaaaaaaaaaatctagtggctaaacgtaaatgaaaaaaagtacctattaattacactctgacctcggttcatcctgggaaagggtttcagggctcataattgtggcagacttctatgtaaataaagtactttgctcgaactactgtaataacctaacacagactggaggacttaaagagaactttcttctctcacagtcctggaggctggaagtcggagacccaggtgtgggcagggctggttcctcctgaggcctctctcctaggcttgtcgatgccatcttctccctgtgtcctcacagggtcgtcctctatgtgcgtctgtgtcctcatctctgtttttatttattttttatttatttctactttgtgagatagagtcctgctctgtggcccagactggagtgtagtggcacgatcacagctcactgcaacctccacctcctgggttcaagcgatcctccggcctcagcctcccaagtagctgggattacaggcatgtgccaccacagccagctaatttttgtatttttagtagagatggggtttaaccatgttggccaggctggtctcaaactcctgacctcaagtgattcgcctgcctcagcctctcaaagtgctgggattacacgcatgagccacaacgcctggcctaaaataattcttgcatacacactttccatcttgggtccttcctgaggataaacccacctgaacagggcacctgttccttccttcagcccttccctccttctttcatcggtttccttccttctttcctctcattccatctttccatcctcctttctcccttccttccctctcctttccttcctttctccctactttcttccttccctccttctctctttctctccttcctacttttttccttcctcagccatctcactactaagcctcattcaagaggcgtcatcccatcacggttaaaagctgtgtgaccttgacaagccccctaacctctctaaaattcatctaccaaatagggatcataatctttacccccactgggtttaagtgaaataacacacagaaagcacatcacacagaataataaacgtagtaaatgaatgcatctgtaagcgtgaaaacattcaaacatcggcttcccaaatgtcccatgtggcagtggttacccagccctatccatttggcaaggactcctcccagtgtgcacttcaaatgggtgattttgttgtatgtacaccggaataacactgacccgcctcccccaagataggctaagaggaatttaaaaaaaaaaagaaaaagtaagcaaaaccaggctcggtggcgcatgtctgtaatcccagcactttggaaggccaaggcaggtggatcactggagcccaggcgtccaagaccagcccaggcaacatggtgaaaccctgtctctacaaaaaatttaaaaattagctgggcatggtggcgcacatctgtggtcccagttacgcaggaggctgagcagggaggatctcttgagcccaggaggtagaggctgcaatgagtgccatgactgcaccactgcactccagcctgggagacagagcaagaccccctctcaacaacaacaacaaaaagtaagcttcacagaagcagagctggtgtgtgtttcttcttattctgcgtggcactgaatgtagacattcatgaggacctgtgggctgaacagcacagctcaccttccagaatcaaggatctcacaccagtaagtgggggctgagagcaaaatctcctgccacagggaaatggataagaagaggagtttgtactcccaactcagctcctttattccaaaagtctgatatgtccaaaacataagtcttaagatgcccattgaagacacgtaggcaggttccatctgtaccaggtctgggaaacaatgtctctacttacgatcccagaatgaaagctgatgattttttttttttttttggacatggggtctcactctgttgcccaggctggtcttgaactcctggcttcaagcaatcttccacctcagcgccccaaagtgtcagaattgcaagcgtgagccactacacctggccttgaacatagttactttgttttaaatctttttttttttttgagacagagtctcattctgtcacccaggctggagttcagtggcgcgatctcagctcactgcaacctccacctcctgggttcaagcgatttttctgcctcagcctccagagtagctgggattacaggtgcctgccactacgcccgactaattcttgtagttttagtagacacggggtttcaccatgttggccaggctggtctccaactcctgacctcaggtgatccgcccacctcgcctcccaaagtgctgggatcacaggcgtgagccatcacgcagaccaaatctattttttaattatggtaaaatacgcacaacataaaatttaccatcttaattaaccattttgaagtgtacagattaacggtgttaaatacattcacaatgttatccaaccaacaccaccaaccatctccacttggacttacttttatttatttttaattaattaattaattttttttaagagacaggtctcactctgtgccacaggctagagtgcagtgatgcaatctcggctcactgcagcataaactcctgggctcaagccatcagcccacctcagcctcccaagtagctggtactacaggcatgcgccaccatgtctggctaattttgtttttgagatctcactttttcacccaggctggtctcaaagtcaagggatcctcccacctcagcctcccaaagtgctagaattacaggcatgagccactgcgcccagacttaacttacttttaatgggaaaagtcacatgcaggtcctcagtaagcagattaacttagccaataataaggtaacataatgagaaatcatgtgggtgagacagcaaatggctgatgtcaaagtaacttggataacaaaaatcactaattttttagatgttttgaggattatacacctaagaggtaagtgccttaataaactgtaaatgccagtcaactataagaattcctaaggctcaaacacagctggcacaacagtccctgaattaaacacatgcattgtccatcaccaccctgcacactcaccccacatattttaaataatctgcatttctttccttaaactgtgatgcttaaggaatcttgaacatgggcatcccaggggctaaaaaaaaacaggatgcaccaattcaatgggggagagaaggtgagggtggatgagccctaattctccctaaaatgcaggagaaaaaaaaccccaaacaggccaatgttgagacatcatgaccagaaatctttgcaagaggagagcgtcacagtggctccgctgagacaccaaggacagcatcgtgttcctcatggacactccaagagaggtggctacatggaaaatacacttcaaaaaaggtaaaaccccatcctggccaacatgggaaaaccccatctctactaaaaatacaaaaaattggctgggcgtgacagcacatgcctgtaatcccagctacttgggaggctgaggcaggagaattgcttgaacccaggaggcagagactacaatgaggcaagatcacaccactgcactccagcctgggcgacagagcaagact[141 bp omitted]gaaaccccatctctactaaaaatacaacgattagccgggcatggtggcaggcacctgtaaccccagctactcaggaggctgaggcaggagaattgc[133 bp omitted]cttgtctacagcctgggaggccagttacctgccacattagcttgggagggaacatgctcttgttccacacctatagatgggtggaggccaggagcagtggctcatgcctgtaatcccagcactttagaaggctgaagcagaaggatcacttgagcccaggagatcgagactagcctgggcaacatagccagacaccatctataaaaaaaaaaaattttttttaatgagccgggtgtggtggtatgctccagtagtcccagctactcatgaggcagagatgggagaattgcttgagcccgggagttggaggctgcagtgaattatgatagtaccactgcattccagcctgggcaaaagagcgggacccccatctgtttaaaaaaaaaaaaaaaaagtgaggctcttctccataagtgataatttgcttctatattgagaaaggactttggagaaatatacaagacacattaatatgggcacctgggtggaaggagagggcaaattctgcacaggtgaggcacaaaaacagatgcatttcactatataactttctcaccttttaaaatttatgactatagaaatagttcatcaacataggttcaatttatgttaaattgataagtgaaaccgacgcattgcattaaataattgtttcaaaataatgatatcagaacgtacacatttatcatcctcaaactcagttcttttccttgacattttcccccctgggtaaaatcaataaaagaacattaaatgctaccatggaggaaataagtgtgtgaaacacgcagttcttctttacgaagtcgatttttggaattactgctgcaaacaagtataatgaccttctattttatagacaggaaaaaaagctgttaaaaagtatttttaaaaaagagtgtgtgttgccaggcatggtggctcgtgcctataatcccagaactttgggaggccacggaaggacatcagttcaggagtcctagaccagcctgggtaacataacgagaccccgtctctattaaaagatcaaaaaattagcagggcgtggtggttacacacctgcagtccaagttacctgggaagctgaggcaggaggatcacttgagcccaggagttcaagacagcagtgagtagtgatcgcacccctgtgctctaacttgggtgagagagcaagactctgtctcaaaaaatgaatgaatgggctgggcgcggtggctcacacctgtaatcccaacactttgggaggccaaggcgggcggatcacaaggtcaggagatcgagaccatcctggctaacacggtgaaaccctgtctccactaaaaatacaaaaaattagccgagtgtg[135 bp omitted]cgaaaaaaacaaaacaaacaaaaaacagtgtgcttactctgtgaataaactgaaaactaaagaactatgtgtttttaaagggtgaatcttatggtatagaaattgtatctctataaacaatgtttactttagaaaagaatgtatgctttggatattcttgggaaggtattttttatttatattgctgctataaccagtgggtgggggaggaacaagatatatttttaagcttggaatatttacttcaaacttcagttaaaaacagtagagccaattcagccaagcagtgtgtggtagatagtttggtgagttcactggtctagacagttggaaacaaactccctcaaaattttgctgagtcaaacaacattccatttttacactgtcctaatttaaaagatgcagatgtttcagaactacactctccgatgtacagtgtattaaattacactttctcatcagaaatacaaaatgtggccgtgagtagtggctcacacctgtaatccccacagttgggaagccaaggtgggcggatcacttgagcacaggagttcaagaccaggctagacaacaaagcaaaaccccatctctactaaaaacacaaaaaacagccaggcatggtggcatgcgactatagtcccagctacttgggaggctgaggcaggaggatcacttgagcctgggggcgggggttgcagtgagctatgatcacaccactgcactccagcctaggtgacagagcgagaccctgtcccaaaaaacaacaacaaaatacaaaatgtataatcacagaagtgaaaagaaaaacaagaaattctcatcttctcccacaacactaacagatgtgaagccagggaaaggttcgtgatttctggctcagtgtatttatacaagcacagtatgtgcagctttcaataacatttgagtgcaactctaccaagaaaaacaagggctggttttcacacatctacaatacaatccagccaggttaaagatacatcctagcctacctccacgatagtgttgcgggataaatcagagacggtagagaccgagcacagttaggagatgaccattataattataattattaaggtgatcaccagctcagtcggactagggtctagaaagtctgagccccgtacagagggatcaatcaccttttaagcagtttgtggcgggagttacgtgctgcagaaagcgtacttgcagaagcgagaacaaaggcagttaattactcttttgcatttgttacaccgtacgtcttacattcttgggaatacatacttttgcagcaattgcttgtcaaccttgtgactttacagctgcactagggagggaagcaagaactcgccgtgcctcaaggaatgtaaaacgatggaacacagataagcctctctgggcatagaggagggataagcagttagtattctctcttaacccagtccccccgccccgggggagtgggctacattacattctaccttcaagaaaaataacaatttttcgaccattacacttataaaattcattaattcccccttcaataggatgcaacaatcccgcaggactcccccgaattacccttgagatcagcttctcaaactgagtccattaacatttggagctggatgattctctgtggtggggccatcctgtgcactgtaaggtggcaagcagtgaccctggactccacccacctgttatcagtagcacctccctgagctgtgacaacaaaaatgtctccagacttgtccagggaagaagtatctccctgatggagctgaattgccattggcagagaatctctgccacagacagatagaaagataggtagatgggtatgatagacagatagatggatagatagaaagatgattgattgattgaatgactgactggatggatggatggatggatggacaatgggtatgatacatacatggaaagagaaagatgatacactgattaattgattggatggatggatggatgggtaggtgggtaggtagataggtaacagataggatagataggtgatacatagataattaggatggttagataattgataggtaggtaggtaggtagataacagatgggatgggtggaggggggagggagggagagcgagagtggggaggggagagagggggagagagagagagagacagaaagagagagactgactctcacgctaaagcaggttctctcagcctagcactgccgacatttgaggctggatgattctctgtagggccatcctgtgcactgcaaacctgcagagtggcgtccctgggctccactcaccacacgccatcagcatccacccccagtagtgacaaccacaactgtccccagacactgtcaagtgccctgtgggggaaggccggcccccagttgagaccccctgttttggagcaagcactgcccgtagtatcgcctgcaatgataggaatgttctctatctgcactgtccaaaatggtagccacaagctcacaagtggctactgaggatttgaattgaggctatggagagtaagcaactgaacttttttttttttttttttgagacggagtctcgctctgtcacccaggctggagtgcagtggcgcgatctcagctcactgcaagctccgtctcccaggttcacgccattctcctgcctcagcctcctgagtagctgggactacaggcacccaccaccacgcctggctaattttttgtatttctagtagagacagagtttcacca[136 bp omitted]ctttagagttcctaccactgagacacactgaattctttgattaggtgtcggcttctaacactccataaccacaatgaagtggtttatgcagtccaggttttgaacacaaaatagcttttgggaaaaaaaaggagtcaatataataaatgaatgcatcacttccatcatgattgatattttcctgggtctcaggtgctgtctacctccgagaaactgcaatgaacaacacaaggttggtccctcatttagttttgtttagttccagtcgggctggaaggagggcaggaagcattaatgacagtaagtctaacaacttgggtgacctcacatgagtttgttcagacttgaggacttcaaacaacatatccataggagaacattgggatgcatctaaccttggtcaaggggtcagggaaggcctctttaagaagtaaaatttccagtgaaaatgggaaggtggtggagatggagggttaaagtcctgttcataaggtgcttgggcagagaatgggctcaattaggctgcaagagggagggtggagatgatcacagcttagggtttgggcatctacgcagtgagtgctgccgacttaggcaaggtgtgcaggtgcacaggggtcttttgggttgctttgatttgggggaagaaggggacacatttcatgtttaacccaggggatgtattgagattgagggatagactaggttgaatggtgccccccaaaaatatgtctacatcctaacccct[139 bp omitted]aggtgaaaccgcgtctctactaaaaatacaaaaaaaaattagccgggtgtggtggcgggtgcctgtagtcccagctacttgggaggctgaggcaggagaatggcgtgaacccgggaggtggagcttgcagtgagccgagattgcgccactgcactccagcctggacaacagagggagactccgtctcaaaaaaaaaaaaaaaaaaaagaaaagaaaatagggtctttgtagtttctattaagtaaacaatctccagataaggccatcctggatttagggtgggacctaaatccaacaacgggtgtccttctaagagacagaagaggaaaaaagagtaataataaaaaatggccagtgagcatggtggctcacacctgtaatcccagcactttgggaggccaaggcgggtggatcacctgaggacaggagttcgagaccagcctggccaacatggtgaaatcccgtctccactaaaaatataaaaaataagccaggcgtggtgtcgggtgcctataatcccagctactgaggaggctgaggcaggagaatcatttgaacccgggaggcagaggttacagtgagccgagatgatgccactgcactccagcctgggcaaaagagcgaaactccatcaccaaaaaaaataaaaaataaataaataaataaattatttaaaaaaataaagagccagatgaggagacacagacacagaggagaaggccacatggagacggaggcagactggagtgatatagccacaagcccagggatgcctggagcccccaggagctgggagatgcagaaaggatcctcccctagagcctccagaaggaactgcatacaactctagtagactgaactgtggtccccacaaagatatattcacatcctcatgtccagaacctggaatgggaacttatttggaaataaggaactttgcaaacgtgattaagctagggatcttgagatgagatcgcgctggaaaagggtgggccctaaatccaatgaccagtgtacttctaagagacagaagaggagacacaggcacagatgagaaggccacgtggagacagaggcagagactggagtgctgtggccacaagcccagggatgcctggagcccccaggagccgggagaggcaggaagcttcctcccccagagcctccagagggagcacaatcctgcctgcactttgatttcagactcctggtgtccaggcctgggagagcataaatttctgttgcttgcgttccccagtttatggtaatttgagacaatggagcaggacactcatataagagtgttgctggatatcttgggaaaaatggaccctccaacgggcagtagttggcaatgcacccttcagggctcctaagaaaggtctaaactagatgtgtgctttgagacccaaagccttaagatgataactgaagtcacaggcacagatgagatcacccttctaatttatttaatgcaatgtttttcttttaactttcagcagtcccatataaagctcttccttcctctttctcttttattgtaacatcctatttttgtggatggagacaatatcctctccaactcttcaaaaaagatgtctcaaagtgagattttttgttttctcttatatttcccttttggattttcttgttttgttttgcttttgtttttgtttttgagacaggatcttgttctgtcgcccaggctggagtgcagtggcgcaatcttagctcagtgcagccttgaactcccaggctcaagcaatcctcccacctcagcctcctgagtagctgggactaaggtgtgtgccaccacactcagctaatttttgtattttttgtagagatagggtctccctatgttgcccaggctggtctcaaacttctgggctcaagcaatcttcccactcgacctcccaaagtttgagtcacagcgcacatgacccccttttgcttttaatcttctcttaggttctccgaatgatctgtcatttctgggaccacatgtctttacttccattaagctctcccacagtttcactgatagctagatgccagattcatggtggttttcctaagaatgacacatcagaaagagtgcctcaggtttcttcggtgtaaatgatgctgggggacagcactatcctggagtgccaccaccccgctgtcttctgtagctctctcctacccagtgcctgccttttcatttccttctatttctttacaaagaaaaccctactggtgaaagcttgcatcctcccaaaattcccgtgttgaatcctcatccccaaggtgatgatgttagcaggtggggcctttgggaggtgttgaggtcatgagggtggagcctcatgaatgggatcaatgtccttattaaagggaccctagagagctccctcaccctttccaccatgtgaggacacagtgagaaggcgccgtctatgaaccaggaagccctcaccagacaccgaatgtgccacgccttgatctgtgactcccagcctccagaactgggagcaataaatgtctgtttaagccccccagtctatgatacagacactcctcaacttacaatgatgacattacaccccataaaccctttgtaagttgaaaatatggtaagtcaaaaatgcatcgaatacacctaacttacgaacatcacagcttagcccagcctgccctaaacgtgctcgcaacatttacattagcctacaactgggcaaaatcacctaacgtgaagcctagtttacaatcaagtattgaatgcctcatgtaatttactgaatactgcactgcaagttaaaaacagaacagttgcatgggtactcgaagcgcgggttccacggactgtgtctttctcaccatcgtaaaatcaaaaaatcttcaatcgaactatcctaactcaaactaccataactcaaaccatcataaatggaatcatcataaattagggatcttctttataagacagacttttttttgtttggctggacgcggtggctcacaactgtaatcccagctcttcgggaggccgagggaggcggatcacttgaggtcaggagtttgagaccagcctggccaacaaggcaaaactctgtccctactaaaaaaacaaaaaatagccaagcatggtggcatgtgcctgtaatcccacctacttgagaggctgaggcacgagaatcacttgaacccgggaggtggaggttggggtgagccaagattgcatcactgcactccagcctgggcgacagagcaagactgtctcaaaaacaaacaaacagaacaaacaaacagacaaacaaacaaaaagctacctactcaccaggcacagtggctcatgcctgtaatcccaacactttgggaggccgaggcaggaggattatttgaggccagaagtctgagaccagcttggataatacggcaaaccatccccacacccccatgtctactaaaaatacaaaaaattaaccaagtatggtggtatgtgcctgtagtctcagctactcgggaaggcgcggcacgaggactgcttgagcccaggaggtgaaggctgcagtcagctatgattacgccactgcactccagcctgggtgacaaagcaacacccagtttctaaaaaaaatagaaagaagtcacttgctctatcttcaccatcctgctattaaattggagacctgcttcctgcacactctgttactcctttatctcctgggtcactaatctgagaacaatcctacttcttactttccttatcaccaggcaatgtttgttttcattaatcacaatgtccttttttttttcttttttttttaagatgcggtctcactctgtcacccaggctggagtagagtggtgtgattatggctcactgcagttccaacttccaggctcaggcgatcgtcctgcgtcagcctcctgagtagctgggaccacaggtgctcgtcgccatgcccggctacacttttttgtttttgtttttgtagagacaggttcttactgtgtcgcctaggctggcgttgacctcccaggctcaagcagtcctcccgcctcggccgcgcaaaatgctgggatgacaggcatgggcaaccgcacacagccatgaatcaccatgttttctttacacagtctgggaaccccagctgagagtcacacagaacatgctttctggaacaagggcatcccaagggaacaattgacaaaatcgccttttggagcacacacaggtctacccaggggcactctctgttctgctcactcaacaagaacaccaggcagccagctagggaacagaggattcctttcccacacaatgcggccattctttcctgagcaggtgggtgggccagccgcttagtttcatctgaacatttgccaacatccaaagaattagagtgttttcagcagccttaagcgttgtcatgaaatcagccaaaaacctgtgatgcgtatggctgggtgtacaactacggatcttgtagtgactatcgtatatgctggcataccacagagccacagacgcaggaagaaatgcaaagcatcctactgaaaaaactcaccaactacatagaaagaagcaatttttctctttttctcttttttatttttagagagatggggttttgctgtgttgcccaggctggtctcgaactcctgggccttgaaaggtgagagtgatcctcccacctcggcctcccaaaatggtgcaattacaggcatgagccaccgtgtccagaaaaagaagtaggttttcactttttgttgttgttgttgttgttttgtttttgtctttgtggttttttctacatgtgttttgttttttgtttttgtgtgtgtgtgtattttttgagacagggtctcactgccgctcaggctggagtgcagtggcatacacagtggtgtgatctcggctcactgcaacctccgccttccgggttgaagcgattttcgtgtctcagcctcccgagtagctgggattacagatgcccgccaccacacacccggctaatttttgtagttttggtagagacagagtttcaccatgttggccaggctggtctcaaactcctgacttcaagtgatccgcccacctcagcttcccaaagtgctgggattacagatgtgagccaccccacccaaccaggttttcacttttagagaggtggagaatctatcccagaccacacactcgcccaccatcccacaacttccaaaattcttttttttttttttttgagatggagtctcgctctgtcacagatgtgtgccaccacgcccagctaatttttattttatttttttttttgagacagagtgtcactctgtcgcccaggctggagtacagcggcaccatctcggttcactgcaatctctgcctcccaggttcaagcaattctcctgcctcagcttcccaagcagctgggactacaggcgtgcaccactacgcccggctaattttttgcattttaggagagacggggtttcaccatgttgcccaggctggtctcaaactcctaagctcaggcaatccacccacctcagcctcccaaagtgctgggattacaggcgggagccaccgtgcccggcattttttaaagtttttctttttcttttctttttttgaggtggagtctcactctgtcacccaggctggagtgcagtggcacaatctcagctcactgcaaccaccgcctgccgggttcaagtgattctctcacgt[136 bp omitted]tggcctcccaaagtgctgggatgacaggagtgagccacggcgcccagccagggtttcactcttaaagaggtagagaatctccatcccaggtcacacacttgcccaccatcccacaacttccaaagttctaaatgagcatcagaaacactacagccaaatggcacaatttcaattgagaatgctttcagtgcaaccttcctgtttatttttacttttccctttgaaggaagacaagctcccggaactcacacagctgtcctgaaatgcatcgtatttaaggacatgcctctgtagcaggtggcggctgccttgttttctgcacttatttctgtggctttttgggtgaagaggagactgggagtgttgattacacagaggaggaagctggagctaaaacagcaccagctgagtaagagaaacttaaaaaaaagcagagctcaatcagagcctaatagtcacaagctatgaacacatcagactacaaaaaaccaaaattaggcggtgacctttgaaggtcaaaagggatggagtttcctaacagttttcctcggttacaattctacttcttctaggaccctctggcttgtgacagccaaagcaccagctcagaatctgtatcaaaatacaatgtttcaggaaattccagaaacctaaaacgagtggaaaaaacgaaagaaaaaccagagcaaaacgcaatgtaactgaaaacaggaagttaacggagaaacataaaggaaaccctaagctgtttctttgcaaagactgatgaaattgataaaccagaatctattctcaaaataaaatcctaacctatttaaggataaactaaacaaaagccttaatacataaaatcacgtccaacaacaactatttgtattcaactatccagggaatattttgagtcgttactgattttttttctatgtttttcttttacttttttcttctctttttttttccttcttctttctcttttttcttttctttcttttctttcatggtctcactctgtcacccaggctggagtacaatggtgcaatcatagctcacttcgacctcgacctcttgggctcaagtgatcctcccacctcggcctcccaagttgctgggactacaggcacgtgccaccacgcccagctaattgtttgttgttgttgttgttgttgtttgtagagacaggttttcaccatgttgccgaggctagaggctagtctcgaacccctggcctcaagcgctccacccacctcaacctcccaaagtgttgggggattacaggtgttcagccaccaagcccagcccgaaaatcaatgaagttgacaagacacaatctgttttcaaaagaaaatactaaactgtttaaggacgaactaaagaaaagctttaataaacaaaatcattctattccagtgtccagggaatattttgagtcattatggactttttttctatataaattatttttttcttctgttttctttcttcatcttttatttccttttctttttttccttttctttcttttctttcagaatgttgctctgtcactaaggctggagtgcagtggcgccatcatagctcactgcagcctccaactcctgggctcaaatgatcctcctgcctcagcctcctgaacagctgggattataggtatgcgccaccacacacggctgattttattttttgtaaagacaaggtctcactatgttgtccaggctagtctagaactgctagcctcaaatgattctccctccttgacctcccaaagcactaggattataggcgtgagccactgtgtgtcgcctactttttctgaaggtgtcattgtaaacaaaatcaaccagcccatgaagaggaaattctagacaagttgctttctcagcaccttttgatttttggaatctcatccaagctggattttgcgatctttgaagaataattccctatgacattgtctccaaccataagctagttctgtcagcggcatctgaaccagagcaactccatcttgaagaggagctgggtaaaatgaagctgaagcctgttgggctgcatgcccagatggttaaggcattctaagtcacgggatgagataggaggtcagcacaagatgccggtcataaggagcttgctgataaaacaggttgcggtaaagaagctggccaaatcccacccaaaccaagatggtgacaagagtgacctctggttgtcctcactgctacactcccatcagcgccatgacagtttacaaatgccacggcaacgtcaggaagttaccctatttggtctaaaaaggggaggcacgaataattcacctttcgtttaccatataatcaagaaatagccataaaaatgggcaaccagcagccctcgaagccactctgtctatggaggagccattcttttattcctctactttctcaataaacttgctttcactttactctatggatttgccttgaattttttcttgcacaagatccaagaaccctctcttggtgtctggatatggacccctttctgttaacagctctgttccctccactcttgtcctctcattgccaagactccaacataagcatgcatacccaaataaacgcaggcaggcttcacagggtccccctctgcctgcccatccaaagagatcccaggtgccctaagcatgacaaagcacttctttcttctgtgccaaggtttctctggccacacctgtgtgcaacccttttgttctgcaaaatgactcccaagggaatgattcaccaaggtgaaaacatccaccaaattagttgtcaacgattttaaaagaaccctccacaggctgccctccaaatctctttgatggggtacctccccagtataacatccaaaataactacctcggagaataatgtaatgcccacacacaacgcatgctaagtaaatggtagcgtgggttgcaaggatctgtgtggacttgtgcaatttaacaggaactgcgtgagacaacttcctttttctatgtcctggtgaaaaattccagtggatttttaaacaggtacgagggcatggaggccagcagggaagacattgtatagaaggaaggtctatttttcttttttttttttttaattgaggcagggtctcactctgtcacacaagctagagtgcagtagcacaatcgcagctcactgaagcctctacctcccgagctcaagcaatcctcccgtctcagccccccgaatagctgggaccacaggcatgcgtccccatgcgtggctgacttgttttccccctttgtagcagtggggtcttcttatgttgcccaggctggtctcaaacgtctggactcaagtgatcctctcaccctggccttccaaagtgctgggattacacgtgtgagccaaagcccagccgtatttttcaaacatattaaagaatgaccagggtctaaccttgacagttctggattaagcaggatggaaaggcccaaactagtcatatggacagttttatgtcctcctctcttctcttctctccaccttatgagagaatgagctgggcatggtggtgtgtccctgtagtcccagctacttgggagactgaggcaggaggatcacttgagccctgtagtttgaggctgcagctgagctattgattgcacccctactgcactccagcctgggcgacagagcaacaccttgtctctaaaaaacaaaacaaataaaatcatgataatcccttgacctggccactgtatcatctgacagaagacatgaaaggctggaagaactgcccagaggtgtcccacaggaaattcctccataggaaactcaccatactggcaacagcctcccacactgataacctctgtgtggtctccttagaccacaggaaggtggaagccatcagtgctggagggggaaggaatttccatcctcgcacctgagtctcctctgcaaatcatttacatcttcgctaaaggtgttcagacagggtagggtgagtctcctggatgcctattctgccatcatgggagaattgctgggaggcttcaaatgcatctaatgtgtttttgggtttttttggttgtttttttttttttttttttgagatggagtctcactctatcaccccaggttggagtgcagtggcacagactcggctcactgcaacctctatctcccgggttcaagtgattctcctgcctcagcctcctgagtagctgggatgacaggcacccactacggtgcccagctaatttttgtatttttgggtacaaacggggttttgtcatgttggcaaggctggtttcgaactcctgatctcaagtgatctgcccacctcggcccccaaattgctggaattacaggtgtgagcccccacacccggcctctaatggctatttatcatgttttctcctactcagatcaaatgcaaatgccaactggactttcacttaagatcctaatggggaagcaaaatgtccatcatcctgtctcacccaacacagcacagaatcggagacgccgggaaaacatgcccacccaagaaatgcagcgtgaaaacgctccagaaaggaggagcttcttgaaagtattggttgcattagtttcattcttcttgcacaagggaaccctggaaaaaaaggggcctgccaagtttacccgcacacacgtattaccaaattcatccacatgcccaggtttctgtgcaaacaatctgccctctagcacctgtgtttctgtcttgctcctccagtagg[137 bp omitted]catgacgagactatctctaccaaaaaaaaatcaaaacaatagcctggcgtggtgatgcacacctgcagtcccagctcctcaggaggctgaggtgagaggatcccttgagcctgggacgtcaatgctgcagtgacaccacgtcactgcactccagcctgggtgtccgagtgagaccctgtccaaaaaaaaaaggagtgagataatgccgtatttgtctctctgtgcctggctcatttctcagagcataatgacctccagttgcatccacattgttgcaaatgacaggactttattctttttacaggctgaatagtactccattgtgtagagaccacattttcttcacccagtcatctgctgacgggcaagtgggttgttgccctatcttggctgttgtgtgactcgtgctgcagtgaacctgggagtgcaggtatctcttcactgtatgtggttttaagctactatatttgcggtccttcattccagcagccacgcaagactaagacagtgtgaaagagcataaaagaggtaatgatagaccagcgcattgcagctgcctttccatggaccctgccgcgtggggtgaatagagccccatctaaatccatttcggctgccatcacaaaacacggcagactggggcttagaaacaacagacatttaccgctgtcagtcctggaggctacaagtccaagatgaaggtatgggagattcagagtttggtggggaccggctttctaattaacagacggtgccatctcactgtgtcctcatatagtggaaggggtgagggagctctctggggtcccttttataaggacattgatcccattcatgagaccccaccctagtgaccccatcacctcctaaaagccccacctcctaacaccattaccttggggattagggttttgacataagaatcttggggtgggggacacaaatatgatgatggtggccccagacttggttttgggactggacccaccacagtagaggaccacggggaggccacctggagaaacaggcagagggaacccgtcacacagaaacatcggttccaccttctcacactgggcttaccaggaagcttctaaccacagacttttctaacagggaaaacgaggtcacaattctaagtaaagcactttcagctttttggaagggatgccttagggcttcctctgtatttcccccaaggtttttcttttctttttttttttttgagacagagtcttgctctgtcgcccaggctggagtgcagtggtgtgatctcggctcactgcaagctccacctcccgggttcatgccattccgctgcctcag[136 bp omitted]tcagcctcccaaagtgctgggattacaggcatgagccaccgcacccggccggtttttctttaaaaaaaaaaaaaaaaccacaatgtcatcaacattactacctttttaagatatatctctcactctttttttcaactttacatatgcgatttcatgctggagagaagaggaaactgatggatagaaaaggtttactttttggagaccctacagtgtgccaggcactgtgtactcatctcccttgatactttctttatttttgacatagggtcttgctctgttgcccaggctggaacacagtggcaccatcatggctcagtgcagtctccacctcctgggctcaagcaatcctcctgcctcagcctccctagtagctgggactacaggtgcattccatcacacccagctacttaaaaaaatttttttttgtagcgatggggtagtgctatattgtccagacagatcttgagctcttgggctcaagtgatcctcccacctcagagtcccaaagtgctgggtacaggcgtgagcctccacacctggcctcccttgaatttttattttttgagacaaggtctctgtcacccaggctggaatgcagtagcacgatctcagcccactgcaacctcaacctcctgggctcaagcgattctcatgccttcgccctcctttgatttttacaagtatgtctcttcctggtggggggtgtctgctgctttcgagagtttaacgtctcccttctttgcagcgtgcccatgaactgtagatgactctgcttttgtcgtccaatcccaatgtgcacgccctgctttcccggggaggaggcagcgtgctgcaggcgaaacccattgggcacacagcatcccttctctcagaccctctttcccattaagaaaataaggctacaagcatggtggatgcacctgtagtcccagctacgtgggaggctgaggcgggaggatcacttgagcccaggagctcgagaccagcctgggcaacatagcaatgcccatctctacaaaaataaatacataaattagctgagtgtggtggtgcacgtctgcagtcccagctacttgggagactgaggtgggaagattgcttgagcctgggaggtcgaggctgcagtgagctgttgattgcaccacggcaccccagcctgggcgacagagtaagaccctgtctctaaacaaaaaagcaaaaagaaaataacactaatgttgtcatggtggagcttctgcccatagagaaactaatgtacatattgtacccgtccagtacttggcatcagtgagtgtcataaagaacaactgccgataatgccatcatccattcatttatttattcacacacagagtgaccagcttgtccctgtctctgcctgcgactctcccagctagcactgaaggtttcccacctcaggaaaccccaggcacatgaggagggttgatttctctattcatgcggtggatggtcttgggcacacactaagtgccgggtctgttctttggatgtgggagatgaaagtggctccaacacacagaggtccctgcacacttggcatttatgtgccagcagcggaggcaggcagaatgcttgagcccaggggttcaagtctagcctgggcaacacagcgagaccctgtctcttttatttaaaataagtcctgcacatgtatcttaatttaacttaaatttaatttaacatgtattttaacttaaattaaaaaaataaaatgaaataaacaatgaagaggagaaaccggcaggacttctatccttggaaatgttctctgatgtgtaatatttgatctcatctcttggcatttgcgtgatgcacttaaaggaaactgtcattcacacatgcatgagcctgtctcacacggagcacccacataaggtaaataagatcaaagggctgagctccactttctgtgtattgttaggctacaaacaacactcctaattgctatgtcaacactgcccacaaggctgctgatttatgcacacagtagaatctcaccagttcagatgccattcgtcccggcagcatgctgtgtgacagacagggtggggatgccgtggactcaatgtctgtgtccccctaaaattcctgtgttgaaatcctcacctgcaaggtaatggtgtcaggaggtgaggccctagggaggtgatgaggtcgtgaggttggagcctcatgaatgggatcactgcccttataaaggggccccagagagctccctcaccccttccaccatgtgaggacacagcgagaaggcaccatctatgaaccaggaagcaggtccccaccagacaccaaatctgccatgccttcatcttggacctccagcctctgaactgtgaataaatgtctgtggtttataagccacccagtcggtggtgttttgctacaactgcctgaaccgactaacttgaggcattaataagaacccagcaacaaggagaggaaaggaaattctggccaattcaggagaaccaaggacaagagaaaacctaccagtataagcactttagatctgagaaccatgtatcattaattatgaagatctcctagctcttaagaaaataaaatattttcagattgtatagtgtgtgaaagtttaaaaaaaaaaaaagtgtctggccaggcacggtggctcacacctgcaatcccacctctttgggaggccaaggcgggcggatcgcctgaggtcaggagtttgagaccagcctaatcaacatggagaaaccccatctctactaaaaatataaaattagccaggcatggtggcacatgcctgtaatcccagctcctcgggaggctgaggcaggagaatcgcttgaacccgggaagcagaggttgtggtcaatacactccaggctgggcaacaagagtgaaactctgtctcaaaaaaaaaaaaaaagtgtcgagcaagaccgaggggtgttctgtggtgagggaattcatcctgcaccatggtttggagggtggtagctgccaaatccacacactgggtaaaactgcacagaactctacacacacactcgcaaacacaaatgagcaccttttgaaaactaataaagcctgaacaagccgggcacgatggctcatgcctgtatatagtcccagcactttgggaggccaaggcaggaggattgcttgagcccaggagttcaaggctggagtgagccgagatcgcaccactgcactccagactgggcaacagagtgagaccctgtctcaaaaaaaaaaaaaaaaaaaagctgaacgaggtatgtgttctctttaataaggatataccaacatcgatgacatggttctgatattgtcccacggatatgaagacgtcaccatggggaagttggctgaagggtccatgagactccaggtactgtttttgaaatcccctgtgagtctgtatttcaaaaaatatatatttttaataggggtctaggaactttggagtcttcctcatcgtcatcgtgtaggacaggttccgtcattatttccctctgtagatgagtaaatgcagaactaggctgagaaaaggaaaatgaaatgtggacccaaggcctggccactggtttacctgttgaattacctccttcctgacaggttaacacttggggtacccatgacaagcaagcactgggttgtagatgccaaatgattccataaggacacttctgggaaaaaacccaagtattttttatctgatatatagagaaaggaattctcaagtggtcattttaagtaggaaattggtaaaataaggctggtagatggctgcacagattcatcctcttctctctacatagggtgagtttttcatttccataatatcattttcttattttattttttatagagaggatctcgctctatcacccaggctggagtacggtggcgcgattgtggttgactgcagccttgacctcctgggctcaagtgatcctcttgcctcagcttcccaggtaactcaggtatgcgccaccatgcccagctaactattactactattttttttaagagatgagggtctcactatattgcccaggctggtctggaactcccggcctcaagtcatcctcccaccgcgacctcccaaatagctgggactacaggcacgcaccactgtacctggccctgaaatttctttttttaaagcacaattgttctccatcataggaacaagcatggcttggttatatgaacaagaaatttgaagaaccagattgaaaaccattttttctctgaggactagtatgactgttctgatccaaagttcctaaaacgaaatcggcctttagaccagacgtactccagaatcccttcacgcataaaaaagaaaaaaagaatccattatcagacttttcacaactgcaaactgcactctttcttcctaactacctgaccttgaggaaaactggtcaatctagaacgctgacaagtttctttttctctctgtcgcccaggctggagcgcagtggtgtgatcttggcttactgcaacctctgcctcctgggtgcaagcaattcctctgcctcagcctcctgagaagctgggattacaggcgcccgccaccacgcccggctaatttttgtattttctcagtagagacagggtttcaccatgttggccaggctggtctggaactcctgagcacaagtgatccgcctgcctcggcctcccaaagtgctgggactacaggtatgagccaccacgcccagcctgtgattggctttaagtcatagaaaataggattgctcagctggcaatctgcatacagatcccctctgcccaccccccaaaaagttcagtactcctgcgggtgcttgtttggggcctgagagaattcggaatgagggcgaaagagcacttaaaagcaaacttatgttcctgtagtgacagtttaggatgaagagaggtcacacccacccagactgggtttcaactccagactgagactcaagctcacccctcactattctccatcacgccttggaaaacagtccaaagctgctgtagattgtggcttagagacacaatcgtgaaggatctaaaaggcttaggattttataaaatgtattattttaggtgaatcacactcagattgctctttaaccaacaataaagaaacgggcttggataaaaggttgcagataatgtcaccaaagctgtgcagttgtcatgagagagtgttccagacgtgcatgcaaacatacacacacacacccctgggtcctggtcccctgctgtccaatgagtgtgggatacctagccctcctgtcacatcgttggagctcacaggaagttatccttgagaaaggagcatcatcctcatcctcattaagagagcactgactggactgaaaaaaaaagctgactccccgcccagccagcttggtccccagaggcagcgacactctatttttaaagatgaggttacccgctgggcaccctaagctgacttgacgtcaaactgagtggccccctgtgacaccagaacccctcacctctgccgccctcctgcccgcatcctgctctctgccccggcctccagccccagctccacctttcccaagggacccatgtgggtgccccaaagaatgacaaacgctggtgctgagtgccaaggaacggctggacctcatcaattttccattgtcgagttgtatttccacctactgtggcggctgcgccagtcagggttcctgccccacccttcttccgcgcaaaacacacccagctctaagattagaccaggacagctttccggggggaccaagacaagggggaaggcagagagagaggagggagggagacagaaaaaccaagaccggaaggggacagggagagagacaccaagagacagaggaggagaaatgcagagagacttgaacagagacagaaagagggagagagaagagaaacagagaaaagagagagagaatgagataaagaggaggagggagggagaggagaaagagagagggcctcctcccactctgtccttccaaattcaggctttcctcgtgggcccttcctcaaggtctaagtggcaaagaggtcactgaaggaagctaagtcccctcttcctcagcggttctaaaggccccactggctatgcccgctggtcttcctaagtcataagctatggcctcgagcccttgggcttcccagcccagcttcctcctttccaaaatgaggacaaacaggagttagagggcctgagagccgacgcctcaccaacacacccaggacagccccctctactctcccatttattttcttgacagccaacaccccacttagccatacggagtccctaagtggcacaggcgggccgatgacaactgtttaaatccagcgcccacgttcagttgggatattctgacccactcagggctgctccataaagcagcgcgtgtccggatgcaagagcaccgagaactcgaaacctctctgtcaagctgcccattcggggttaagttcaaagacagaggacaaaggaaacggataaagcgtccgatacaagaattacccatttcagaggcacaagacgaagagcacaggcggtgtcaggacatgttaggatccgtccccagcgctgccgtcctcgtccccacagcgccccgggacacctgtcccccacagcccagctgctcctgcagcccctggagaaatctgtacattccctgcctctgggcacacagggaggctggcctaggggaggcctgcaggggtcttcgcaccccgcgccagtgtccctggggccgctgccagggagggagcacgaggtcccccaggcgaggtgacccgcaggaggttttgtgacgtcggacggcccaggccccagagtgctgtgtgtgctgggggtggagggtggtctccgagaggagccgtcggcatttcaggttaggcacccggccggtcgggggtacttgcctgggctggggggctggggagtgcgctccacccgggaagacccggggcgcaggtgcagccccgcacggggactccgagccgaagtagcgggtcagggccctccccaggaggtcggcacccagggccctttgtcctactacaacgtcccggccacgccgcgcgcccctgtgggccgagtccccgcccgcactcactcacccacggtggccagcgtgtcaaagtcctgcaggctgtacacaggcggctccggcgacagcgcctcagggctggggcagagcgcgggcgccccgtcgggggtctcctccgccaccttgcgggagtcgctctccgccgcggccgcctgggccagcccgggcgcctccatggggacgcactcaggtccggggcaccgggccaggccggagcgctcggggagccgggcttcccgggacgcagcctcggagggcggcgcggcggcggcatcaacagaggctccccatgcgcgctctcgcctcctggtgcgcggtccggcgcggctgacggagcgacggggacaatggctgggcggcgctcacggcacaagcagcaacggccccgagtgggagcagccgccggcctcggggggcgggcaccgagtgcgggacgactgcggggaaggcgggggccgcggcccgggctggggggggcgaggcgggggccctgcgcattccgggtctcgcgcccgccgcctcctccagctcggtagccgcgtgcgcgctgttggggcgggcggaagccgcctgggcgtgaccgcgcctctccccgccctaacccggccgcggggctgggggcgtcgccttcgcgcgcgctccgcccccgccccgacccagcccaggagccggagacccgggcgtgcggcgctggggaggtgcccacgccccctccgcgcccggggcacccctggggtgggacccaggctgacttctcctcggggacgcactggcgggccacccgcgtcgctgcacccaagcccggaagatggggaggcgagggggcccggggacagggagggcgtagctcagcagaagtgaagttcaaaactaaaaagtgaaactggcgtttggtgaagagaggggctcggattagcccggctaatttttgtattttctcagtagagacagggtttcaccatgttggccaggctggtctggaactcctgagcacaagtgaaccgcctgcctcgttctcccaaagtgctgggactacaggtataagccaccacgcccagcctctgattggctttaagtcatagaaaataggattgctcagctggcaatctgcatacagatcccctctgccctccccccaaaaagttcagtactcctgcgggtgcttgtttgggacctgagagaatttggaatgagggcggatccccaagaggggctgccgggtcttcgggatgagttcagcgtcctggttttgctgtaggactctggtgattctagatttctacttggaaggggcggggaagggcgggctcgaccctgtgcgtttctttgcagcttcctgtggatctagaattctttacaaataaacattcctttaaaaaactagggaaagacagatttgagagatcgcccgaccaaatgtagtgcgtgaaacttgattggtcactgtttcaaacaccccggcgacaaccctataaagaattgtgcagaggcatttcaatttcagaaaccccaaagatttttttttcctggcttaagtgtggctcaggcaatagttggacatacttatatttaaaacccatatccgtgtggatttgaaatgcaaatatagctagatatttggtcacccctttccccagggaaatgcagacagtgcttaacttgcgggcctggcacggcctggacgctgcgcccctgacccgcgaccagggcggcccaggctgccggttcgccgaccacagtttgagcagcaaggggtcaaactgcaaacgcctttgttttgagggatctcagcgattctgcgattggagggggtctccagtccctcagtccgcaggtcaggggggctttccgagagccaaagcggcctctaagtcagaacggacacatttttagggggaccaggccgagccatccttccacagctaacggggagggggagtcaggaagtctgaacctggctcaggctttggatttctggcccctggctgccagcctcgcccagcctccacctgcattttgtgggtggcatttccccccgggggtgacacccgctccctatgctctgcaaaatcctgagctggaatgcaaaacatatgcgacaccagcaggcccctgccatcccctgagcctggttaggacaggtcacggccctgccaagcttcaccagcaagccgcgcaatcccttgatcctggttaggacaggaaacggccctgccaagccctgcctggccgaggggttcagggccagcaaggaacgcgcactcaggaaaagttcgtgtctccccgcggaacgcgcgccctctccactagggcctgaccttggaaatgcaaggctgcggcctcataaagtccttttaatcaaggcccgggtttcacacccaattaagcagatgtccttgcctgcaaattgcacgcaggaagaagaacgtggcacagatttgcagcgttaaactctgcttgagctgctggttggtctgattccaccgaacccaccctgaacttgaccgcatagctacctcttcttataaatagaccctgcacgtttcacaacaccttgcttgacaaaacagctttcatctggaaggatcataaaaatccttgagaaaccacagcctattacttgagagacaaaaaaggaaaatccctgtgagttaggcatggaagggtcattaccgccttaatgaagtggcattaatttgcggtggagtcaggaattgctgaactctgccattcggaaggaataagtccctgaccctaaaccagaatgagctataaattcaatacaatgataggtgcaggtgttgttaaatatgagaagaatcaaaattgtaccatctggcttagcacagagactcacacctgtgatctcagcactttgggaggcatgggggttcgagaccagcctgggcaacattggaacccacccccccatctctaccaaaaataattttttaaactagccacgtgtggtggtgcacacttataatcccagcacagaggcaaaggcacgaggatgccttgagcccaggaggtcaaggctgcagtgagctatgactgcaccactgccctccagcctgggcaacagagtgagatcctaactaaaaaaaaaaaaatcatacaatctctgaagggagctgaacactctttaagcatgtatactgtatgtgtgtgtttgtgtatgtatgtgtgtatatataatgtatatatagccattccatatattatatatactgaattaaatatgttatatatttgtgtatatgtatgtgtacataagtatgcatatatatgatatataatatattttgcataaatgatatataaaatatatatttctatatatggtgatataaaatcttttttctaattttattttttattttttcatttttatatattgaggaggtacaaatgcagactttctgtttttcagtaattttgcttaagataatggcctccatttccttccacgttgctgcaaaagacattatttcattcttttttatggaatcatagtattccatggtgtgtgtatatatatgtttgtgtatgtgtgtgggattacaggtgcccgccaccacgcctggctaatttttgtattttttgtagagacggggtttcaccatgttggtcaggctggtctcaaactcctgacctcgtgatctgtccgcctcggcctcccaaagtgctgggattatgggcttgagccaccgcacccggccaactttacaatttatatatataatttgcatatatataacttatataaatatatattctagtatattttatataatatatattctagtgtgtgtgtatatacgtgaagtgtttagccaccttcgcagacatatacacacacacatatatatattctgagttaaacatatataatatataaaatatatgtatgtatatgtgtgtgtatatatatgtgtatatgtgtttgtgtgtatatatatgtgtgtatatatgtgtgtgtgtatatatatatttatgttgcaacttattgacctaaacatatgcttcagcttccctttcactgccatctgcggtgaagctgccaccaaactgcagattttcgtgaaaaccctaagggggaagaccatcacccttgaggttgaaccctcagatgcgatagaaaatgtaaaggccaagatccaggataaggaaggaattcctcctgatcagcaaagactgatctttgctggcaagcaactggaagatggacgtactttgtctgactgcaacattcaaaaggagcctactcttcatcttttgctgagactttgtggtgttgctaagaaaaggaagaagtcttaccccactcccaagaagaataagcacaagagaaagaaggtgaagctggatgtcctgaaatgttataaggtggatgagaatgacaaaattagtgcccttctgacgaatgtggagctggagtgtttctggtaagccactttgacagacattattgcggcaaatgttgtctgacttactgcttcaacaaaccagaagacaagtaactgtgtatgagttaataaaagacatgaactaaaaacaaacaaacaaacaacaacaacaacaaaaaccatagcttcagaaacacacagtgcctccatactttgttatttgaccaagtgtaagaggtcttcccagggcatctggaaaggggtcctccaagcaatacagtgatcaattcctgtttagaccacgccaggaatggaaactctatcatttcctgaggatatatccacctatgatttggtcttagaaggcaggaagggaattctgataaacgtttagttacagcaatacagtttcaaattttagtactcagatatcaccataattacggtaatgcccttggttgcgtgcctactgcgtcccaggaatagaatccgtcttttctcatgctcaacatagttcattctcgttttctcagatgagccatttattggggcttgagtattttcatgcattatcgagtcatccccaatgcctagcatgttccttacaaggactgattcactgttggtagctttgcaatcttctcttctcattttttccttgtcacaggacggtaccatcatgggttagttttggctttacatgttaggacttcactatagcctaggagttggctacattccagtacaatcttcagtacttctgcctctgctgatgggccgggcccattgtgactaattgaagatgatgaaattgattttataaatgtatgtaaaaccacggttatcagagatctgctgtggtcttagcccagctgaatcaccatcattcccagtcttagaagccacctttttgccatttttcagg[132 bp omitted]tgatgaaacctcatctgtattaaaaagacaaaattagccaggcgtggtagtgcatgcctacaatcccaggtacttgggaggctgaggcaggagaattgcttgaacctgggaggcaggcgagtgaatgagatcatgttgcagtgagctgagatgacgccattgcactccagcctgggcaacaagagcaaaactctgtctaaaaaacaataataataataacaataataataatgtccaaagggacgccttttaaaaacagctgaaacttggccgggtgcggtggctcatgcctgtaatcccagcactctgggagatc[131 bp omitted]ggctgaggcaggagattcgcttgaacctgggaggcggaggttgcagtgagctgagatcgcatcactgcactctatcctgggccacagtgcaagactccgtctcaaaaaaaaaaaaaaaagaaatgtcctcttggatttcttgaggctgtgagtttgagactagcctggcagacatgatgagactctgtctctacaaaaaaaattaaacattagcccagcctggtggtgcatgcctgtagtcacagctacttgggaggctgagatgggaggatcacttgggcccaggaggtagaggttgtgtgagctatgattgtgctactagcctgggcaacagagtgagactctgtcgcaaaaacaaacaaacaaacaaacaagatcatgtcctttacagggacatgggtggagctagaggccattatccttagcaaactaacacaggaagagaaaaacaaatacagcatgttctcacttatcagtgggagctaaatgatgagaacacatggacacatagaggggaacaacacatactggggcattttggagagtgaagggtgggaggagggagaggatcaggaatgataactaagggtcactaggtttaatacctgggtggtgaaattatctgtacaacaaacctccgtgacacaagtgtacttatgtgacaaacctgcacatgtacctctgaacttaaaagctaaaagaaaacaagacaaaacaaaccaaaaccaacttttgaaaaaatgaaaaattataggacttctgagtgaaatgaaattttccacatgtgtattatactcagttcccaagttagagggtcttgaattctcaatgggtttatagggattaattcatccctgggtggccaaatattatagttggacagaacgtcatttagttaaaattcacaacataaaaccctaagccactctttctacaaactaagttttaaaaatctgcaaacgtagaatgcaatcaaagcgattttgttcatgtatcaagcgccgacttctaaaaataatgtttctaaacatgcctgtttatttggaggcttttcttgagcgattccaaagaaaatccaatagaaagccttgaggatgtcctcgttgtcttcgctggtaaccattcattaggaaacgcctagatgagcctgtaattagaatgggctgcgtttactcctcatccaagagacacatgatagtttttatttctgggatactggtaaagtttatggaaaatgcaaactatggtattgaaggaatgcaggtgaataatgtttccaaagcggtaaacaaaagcaccagaaagaaaaatccttccttcaaaagggaagctaatgggatgtgttcatgttattgtttaactggatttccagatttgaacgtcacaggtaacatttcactcgaagaataatagaaatgatgtgtatggaagcaagtcagtaa[133 bp omitted]agaccccatctctacaaaaaaaattttttttcaattagctggatgtggttgcgcttgcctataatcccagcgatttgggaaactgagatgggaggatcacttgaggccaagagtttgagaccagcctgggcaacatagtgagacccatctccatttaaaaagaaaaagagagtaagataaccatggacacccatcgctgtgttctgtaatatgttaatgaggtttcctttaaatatttagatccctataatgtcaatgtgggaaagcaaaaacgtgtgggaaagcaaaaacgtgtgtgaaaactcttaaccaactctcctgtatcctataagatacgacactggccttgttatttggaattcacttgcgtcggatccttttttattcatttattatttggaagagatggagtcttgttctgtcacccaggctaaagggcagtggtgtgatcatggcccactgcagcctcagactcctaggctcaagcgactctcccacctcgacctcgcaagtaggttgggattacaggtgcacgccaccacgcctggctagttttttatagagatgggctcttgctatgtttcccaggctggtcttaagggctctcgctatgtttcccaggctggtctcaaacttgtgaactcaagcgattctcctgccttggcctcccaaagtgctgggattataggtataagccaccatgcccggcctgaattagatccttttacttctctttctgctgatgggctttgggctattccctgaagcttgcaggtaacacaaagtgcaacacagtaacgtgagaaaaattataacacatcaagtcacattatgtctctaagcataataagtaacaaaggagtttcaatcactcactatttttgggaaaaaaagctgattttgattctcaccttgcaccgtaattaaaaataccacaaagacatcacaagaaaagaaactgaaataaataccagaagtattaaattgaaattggggacataaatcaaacttgaaacaagcccagtccctggtgggctccaaagaactttctaagcttcatagcgatcgaactacaggggtaaagattaatagatatgactacctaaaaatgtcaagacagttgttgaaatataaaacaaaatgaaaatacgtttacagcaagcttacatagtgcatgagatgaaaggccagactgggccaggcatagcggctcacgcttatgatctcaacattttaggaggtcaaagtgggaggatcgcctgagccttggaatttgagaccagcctcggtgacatagcaagatcccatttctacaaaaaataaaaatgaaaagaattagctgggtgtggtggtgtgtgcctatagtatcacctactcgggaggttgaggtaggaggatcacttgggcccaggaggtcaagactgcggtgagccatgattgcaccactgcactccagcctgggagacagagcaagaccctgtgaaagaaaaaaaggaaggaagggaggaaggaaggaaggaaggaagggagggagggagggaaagaggcagagagagaaccgtcaaagaaatgcaactaagaacaaatgtggcagttgtttgtttatttttaatctaccgaatactaggaagataaagtgttccataatgatgacagaattcttatatacttttggttgtaatgttaattagggcaaagccttagagtgttagaaatgattatatgtgttggtccactcgttctatagctaggaatttgtttttcaaaactaaattccacagtgcagcaaaagcttcatggttataattacctatttatttatttatttgagacagggtctcactctatcgcccaggcttgagtgcagtgccgcagttatagctcactacagcctctaactcctgggctcaagcaatccttccacctcagcctcctgagtaagtgggactacaaacatgcaccaccatgcctggctaactttgaaaaatttttagtagagatgagatcttgccatgttgcccaggctggtctagatctcctggactcaagtgatcctcccacctatacctcacgaagtgttcagatgacaggtatgagccaccatgcccagcctagttacccattattcaacacagtttatttgtttgtttgtttgttttttaaagccagtcaaatttagcagtgggacaaggcaataccttcagcaccttaaaatacgagaaggcgtgcatttacgctggtttgtttatgtgaggaaatcttcaaactcttcataaacaggaacagagtgagaaaactatggttacattttaagacatataggcagcaatccaaattttataatacactccaatcttacagatataaaaatataatgtaaaatgatgagaaaatgtaaaaagtgtggcagacggagttactagaatcttcatttttaatgtgattctccttcttgactacaaacatgaataattttcttgtaatgatgaaacagacttcagaacacacgatagatgatttcataaaagataccaattgagagatttggaaaccagtgtgtgtaaagtgatggatggggttagagttatcttaggacttgctaaattgctgtgattctgtaatttatctcattttctaggggagcgataagaggatatgtactgtgtctcatccatgaatcacagtgtttcacaggtcctgtccagctagtcatcaatacttatcggtacgaggctaatacaaaggaaacctgaaaactgctgaagggcataggaaaaacaaataccctgaccttggaggaaaacatgtacttcagctcattctttccggctgattccatgtggcatcctccccgtcaaagtgaatgtgggaacttggccaagtgaagttaaagtttatctgggagaatcaatatgagacacagaatcgtaaaattttgaaaaaaaaaaaaatacttgtcatcagatgggaactagcctttttcctgacaaagccagagttttgaagatagttttattttattttattctattttattttatttgagatggagtcttgctctgtcgcccaggctggagtgtgcttgcgcaatctcggctcactgcaacctccgcctcctgggttcaagcgattcttctgcttcagcctcccaggtagctgggaccacaggtgtgcgccaccatgcccagctaatttttgtattttttaggagagtcagggtttcacc[137 bp omitted]gttacattggagtccggaagtcatccagcaagcacgtgacatttttaagccttagaaagaacaaatgtttccaaacagatggt[175 bp omitted]caccacgcccagctaattttttgtatttttagtacagatggggtt[148 bp omitted]ccccttatatcaaaataaagggtttttattagttatttttttaaatagagacagggtctcactatgttgcccaagctggtctcaaactcctggcctcaagcaatcctcctgccttaccctcccaaagtgctgggattacaagtgtaagccatcacacctagccccaaaataaactcccgataggtcaaatgtatgtttaaaaataaaatcataaagtactacataaatatatggactttaaaaatgtaagttaaggctggccacggtggctcatgcctgtaattccagcactttgggaggccgaggtgggaggatcacttgaggtcaggagttcgaggccagcctggccaacatggtgaaactctgtctctactaaaaatacaaaaatcagccaggcatgatggcgcatgcctgtaatcccagctacccggggggctgaggcaggagaatcacttgaacccaggaggcagaggctgcagtgagctgaaatcgtgcccctgcactccagcctgggtgacagagtgagactctgtctcaaaaaaaaaaaaaaaaagaacaaaaaacttgactgattttgaagaccatgcccagctctgtgcttagaaggtaatctgagctatttaatgctttatctcaccttggtttgaatgtagggctggggaaggaaagctaaagccccctcccttccaaaaggaagtgaaccttttgattcactgggatttgtgtcagtttgtgactgggcaggatttgtttcctggacgctggcagataagtgtctttgtaagagttgccatacagtgtttctgaaatcctctgttgggtgtagagtgaaggccccacagaaaactggcctgggaaaaagggataacaccttagaatgcaagcttctgttttcagagccgttccctggcaaaagaatgaagtagtttcccaaaagagaaggcgacagaaggattgagtggggttcacttggcaccacccaatttccaattcagccgtattttctgagtagttctacaaacaaaggtcaagttggggccaggtgctgtaatcccagcactttgggaggcccagacaagaggaaggcttgaggccaagagtttgagaccaatctgagcaacacagcaagactctgtgtctatacaaagtttagaaattacctgggcgtggtggcgtgtgccagtagtcccaactacttgggaggctgagatgggatgatcacttgtgctcaggaagtcgaggctgcagtgaaccgtgattgtactactgcactacagcctgaatgacagagcaagaccctatctctaaaaattaaacacacgtacgcacgcacaaaggataaaggcttgaggggctggagactgcatcatccgtgatgtgcctattacgtattgcatgcctgtatcaaaacatcgcatataccctgtaaatatatatacctactatgtacccacaaaaaatttttaaaatgttaaaaaaaaataataataattttaaaaaacaaaccattaaggccgggcatggtggctcacacctgtaatcccagcactttgggagggcaaggctggtggatcacaaggtcaagagagattgagaccatcctggccaacatggtgaaaccctgtctccactaaaaatacaaaaattagccgggcgtggtgacgcgtgcctgtcatcccagctactcaggaggctgaggcaggagaatcgcttgaacccaggaggcagaggctgcagtgagccgagatcgtgccattgcactccagcctgcactacaggagtgagactccatctcaaaaaaaaagaaaatggatttcttgctatattattttctatgcaaatataatctgtttccctcaatggagtctctttcctggtgtacaaagacaagcttgagacaagttttataaaatatgttggttagtggtctctagcattatagattaaagattgttatagaatccacatcttgcaaaatatacagctgtaaaaataatgttgggacctttctcaggagcaacaattactgcatttctcaccctccgtaaatatttatatatggctgtatttcccttttaatttatttcttttatttatttgtgttttgagacaggttctcactctgttgcccaggctggagtgcagtagtgcaacatgattcacagcagcctccacctctcgggctcaagcaatcctcctgcctcagcctcttgagtagctgggactacaagtgcacaccaccatgcctggctaatttttgtattttttgtaaagataggggtatcacaaggctgggcacggtggctcatgcttgtaatcccagcactttgggaggccgaggtgggcagatcatttgaggtcggagttcgagactagcctggccaacatggtgaaaccccgtctctactaaaactacaaaaaaaaaattagctgggcgtggtggcgggtgcctgtaatcccagctacttgggaggctgaggcaggagaatcacttgaacccggaaagtggaggtttcagtgagccaagatcgtgccattccactccagcctgggcaacaagaacgaaactccgtctcaaaaaaaaaaaaaaagtgtctcattctgtcacctaggctggagtgcagtggcaccatcttgtctcactgcaacttccacctcccagattcaagtgattctcctgcctc[134 bp omitted]cagcctcccaaagtgctgggataacaggcttgagccactgcgccaggcccgacatttttcattaactgtgatgagagctggatcgcctcctattttgaaagaaaaataagagagtcgacaaattgcaagcttttccttctgagagactcacgcctgctataaatgagctacatccttactgatgagcttggcacagatctttggaagaaaaacaagtctgaaaagatcaaattagccaggcatgatggcatgaacctatagtcccagcgcttctagagggagaattgcctgaagtcagcagttcaagaccagcccaggcaatataacaagaccccatctctacaaaaaatagaaaaattagctggcatgatggtgcacctgtagtcacagctactggggaggcgaagtgggaggattgcttgagcccaagagttccaggctgcagtaagctatgatggcaccactgcactccaggttgggcaacagaacaagatttcatctctaaaaaataaaaataaatagataaataaaagagatcaattaaaaggcaaatagagccatatataaatttttatgagggtgagagatacagtaattcttgttcccgagaaaggacccaatattattttcagagcggtaaattttgtaataagatgtggattctgtaacaatctataatctataatgctagagaccacaaaccagcatgttttataaaacttgtctcaagttttctttttaccccaggaaagagactccactgagggaaactgaaattatatttgcatggaaaataatatagcaagaaatccattgttgaaaccacagtggggaaaaaagaatgctgtgtttgtggggttttttaagttgtaaaggctgtataaatctaaggagttttcacctatttttgtttgcgcatgtttaggtaacgttacaacaattttacaaatgttggggttgctggcatttgcaaggcattcttagacaaatccaggaagacaaacagtaggcttgattcttctaaagccttcttaagctcatttcaatacatctttaaaatgttaccagaataactaagaacatcttagtttcttggggaaggaatcagcaaacacagcttttctccaggagcagcagcttctaaactcccaacatcctctctctaatataacaattctctccaaagtaatcttgcctcaaagagaaaattactttgtataaatagacggtttaacattaggcaaagcaagataagattgtttctcaaaatatgtagaccatgctgctgaattgttttgcttaatgtttaaagatatttgagctgattcactccttagcatttagtcacgtcaatgttctcgttcatgagtgtgcgcttgcatgtgctttaactgagcaatgaagatcgcagtgaggggagaaacaatattcgttgcacggacctctgatcttgtcagaacaaccagacctgattgtgagtaatttgtccagttccacccagctgggtgctgaggttcagtgaacgtcactggctcttactattactcatgccatttcttatcttggagagatgccgttggaacaatttaggatctctcctctaactcgtctgattttcattgacctgaaaattctttcaacatactgacataaagccaattgagaagcatccacaaatgctatgaataaaacaacattgctatctgcattaaattaatacccgatttaagcatagtcttgaaaagaaaaaaaagaaggcttacaagttcagaaatgaattgtggtcattatatggataatgttaataaagtaattcaaatgttgaaacaatgtacaattatcatctgtacttcataagccaacttttattaaagcaagagtaatttaattttttttttaagagataaggtctcactgtgttgcccaggctggagtgcagtggtgcaatcatggctcactgaagccttgacctcccaggctcagcctcccaagtagatagaactatgggcacttgccaccatgcctggctaataaaaacaacaacaacaacaacaaaacaaacaaacaaaaactttatagaattggaatctcgttgtgttgtcctggatggatttgaattcttgggctcaagcaaccctcccacctcggcctcccagagtgttaagatcacaggcatgagccactgcacctggccctaagataggagtaaatgaggcaagtggtatcataaatatggaattgacagccacaatgaatactccctctttgatttaataagatggaattgaggccgggcacggtggctcacgcctgtaatcccagcgctttgggaggccgtggcaggaagattacttgaggtcaggagttcaagaccagtctggccaacatggtgaaatcctgtctctactaaaactacaaaaattagccaggcgtaatggtgcacgcctgtaatcccagctacccgggaggctgaggcaggagaatcgcttgaatccgggaggcagaggttgcagtgagctgagattgtgcgactgcactccagcctgggcaacagagggggactctctctcaaaaacaaaggtggaattgaaatttattatcaatttaacccagggtttcgtcgttatcctcttcattttcctgaaatggctggtcctccagcagtcactcaatcatttcccagatattctgtgattgctttcttttttttttttttttttgagacagactctcactctgtcgcccaggctggagtgcagcagcgtgatctcagctcactgcaacctctgcctcctgggttcaagtgattctcctgactcagcctcccgagtagctgggactacaggcgcccaccaccacgcccggctaagttttgtattttagtagagacggggtttcaccatgttggccaggatggtctcaaactcctgacctcaggtggatccgcctgcctcagcctcccaaagtgctaggattacaggcatgagccaccgcacctagtcattctgtgatttctttaagggagcatggtcatttatttttacatatggaaatacattcatgagatttactccagacacacttatcaatattacaagacatatttgaaaacccaaatgtgttccctaaagtatatcctggatagctgagtcacataaaattctttaaaatcaagcaaaatatatgtatgtatatatatatatatgcatacatacacatatataaattgtataagcttaagaattcaaattcttaagtctccctgacacacacacacacacaaaaattaaagctttaagtgttttgtattttccatttaaaaggcattttctggctgggcgcggtggctcatgcctgtaatctcagcattgggaggcctaggtgagtggatcacttgagtccaggagttggagaccagcctggccaacatggcaaaacccggtctctactaaaaatataaaaaattagccaggcatggtggcgaggctgtaatcccagctactcgggaggctgaggcaagagaatcacttgaacccgggaggcgaaggttgcagagaaccgagaccatgccactgcattccagcctgggtgacagagcaagattgtttctcgaaaataaaatctttaaaaaggcattttctgattcaactgttgtctacattctctggcaagtgatagagaaaattacacaaacatttttatctttggacaagaagatctaaaatacaacatttagccaagagaagtgaaaacagaggaatttcggacagctcgcctccttacatgtggcactaacttccccgcttgtgaaatcactatctcataatccaggatctcacaacctcagcactgtggacatttggggttgttggggggtctctgtggcgcggcgatcctggtcacagtagcccccttgttattctcttgaccaacatccctgagatctacccaccagattcaggtagccgcgcccccccttccatagttgtgacaatcaaaatgtctccagacactgacagaggccccctggggcaaaatcacccccagttgtgaataattgctctaatccaaataaatgagaataatgttcaatctatctgaaaatcataaattctgacaaacagctattaattaagacaatggaaatatgatgtatacata[141 bp omitted]tgaaaccccatctctactaaaaatacaaaaaaattagctgggcgaggtggcgtgcgcctttaatcccaggtactcaggaggctgaggcaggagaattacttgaacctggggggcggagggtgcagtgagccaagatcacgccacttcactccagcctgggcaaaagtgaaactctggctcaaaaataaataaataaaaggaaatcctaagaaatgcaaccacacgactgaaccatgagaaccttgtgctgagagaaggaagccaggcacggaaagacaaatactgcaggattctattcacatgaggcacctaagaaatggtacccacaaaaatggttcctttcattttgtgctaagccttatgtcacgggggatataaacagcatgtccagtgtttaacaagcctaagagatgcagaaggcccaagggcaggtacagttcacaaagagggggatggtctgtaaaagattaggtgaacattttttttttttagacgaagtctcactttgtcacccaggctggagtgcagtggtgcaatcttgactcaccgcaacctccacctcccgagttcaagcgattttcctgcctcagcctcccgagtagctgggactacaggtgctcgccaccatgcccagctaatttttgtatttttagtagagacggggtttcttcatattggccaggctggtcttgaactcctgacctcagctgatccacccgcctctgcctcccaaagtgctgggattacaggcatgggctaccatgcccggcgtaagcacctgtgtatttcgtgtttttgattttttttgagacagggtctttcttgctctgttgcccaggctggggtgcagtggcatgatctcggctcactacgacctctgcctcccaggctcaagagattctcccacctcagcctcctgagtagctaggtccttacagttatttcttgattatacgctaaacaaggggtggattattcatgagttttccaggaaagggatgggcaattcccagaactgagggttcctcccctttttagaccatataaggtaacttccaggtattgctgttgcaggactttctccttagttcagataaaagccaggttcttgccacatggccatgattaggctcgcagacattttgaagagtgagaaaaatggaatttattgggcaaaaaggaaaaaaagagaaacagggactctcagcaaagcgagagtccccgctagctggtctccccctcacagattgaatcctggattccacctgaaacagaagaggccagtctcctccccgctgcaaagggcgtgaactccgtggctccagcccattttcccagtgcccgcacagtggttggagtttctccggggaccgctttatacttgactgtctcattgccatggcatttgtcaactgtcgtgctgctggtgggagtgtcttttagtgtgctaatgtattattattagtgtataatgagccatgaggatgaccagaggtcactcttgtcaccatcttggtttcggtgggatttggccggcttctttactgcatgccattttatccgcaaggtctttataacctgtatcttgtgccgacctcctgtctcatcctgtgactaagaatgcctagcctcctgggaatgccacccagtaggtctcagccttattttacccagcggctactcaagatggttcaaatgcctctgacagtgggatggagcaggttctccctttgtaagggcctgagggcccatgaagcatggaagtaaagacaaatcttgagttccttcaaagaaaattccaggcacctggatggccacgagaagtcaatgagcaactcggtaagtaaaaaggtaatggtagcttaaaacaacagccgaggaagctagagtcatgagatgcttggctttctatgggaacgaaagatagcatcttagcatacgtccccgagctgtttttcaggaacccagaccccaccaatcggatctgctggcacggacctcaggtaaggggaactgaggactgaactctgaccaatgtactttgttctaaattccttcctgaggggcctggaggaggtcatgcccacagaccagagctaacagtttttttcttttgtctctagacttttaaacaaagcttcccttccttaacccatcacaaatcagagaatctttgaatctacctatgtcctgcgggtcccccttgcttcgagatgttctgcctttttaggtcaaaccactatataacctccctatattgctttataactttgcctgtaacctctgcctcccaccttgaaaaaccctcacctgtaatccattgggggagggtggggctgttttttttttttgagatggagtctcgctctctcccccaggctggagttcagtggcgcggtcttggctcactgcaagctccgtctcctgggttcacgccattctcctgcctcggcctcccgagtagctgggactacaggcgcccgtcaccactcccggct[233 bp omitted]gccccaacctcccaggctcaagtggtcctcttgcttcaccctactgaggacctgggactacaggagtgtaccaccacgctcagctaattctttaatgatttgtagagacagggtcttagtattttgcccaggctagtcttaaactcctcggctcaagtgatccacccaccttggcctcccaaagtgctggaattacaggcatgagctgccttgcccagctaggaggtcaggtcttaagcatgagctgcatgattctccttgcttggtaccctacaaatacatgccctcctttctcacgctgcaaaccttggtgtagatgtttggccttactgtgctgggccacaccttcagaaggaaccaaccccaccgacactttgatctcagacttcttctggcctccagaactgtaagaacagtaagtttctgaggtggagctcacccagcctgtggtacttggtgaaggcagccgtgagaaatgcatacagctcatttgcacaaaaggcagagagtttgaatcatttgtagaactggagatggggcttcctccaggtggaactgcttgtgaaagttagaggtgtagaaaggagagagggcatttgcgggtgtctttgtgagtgatgctaaggacagatattaaggaagacagttgcagagacaaactactcacaagacatgaggaagttaaaaaggcaaaggatgataagagttcattttccacaaaagagtcagactcagattttttttttttgaaatagggtctccctctgtctcccaggctggagtgcagtgatgcgatcacagctcactgcagcctcgaatacctgtgctcaagcaatccccctgcctcagcctcccaaagtgctgggattacaggcgtgcaccactgcatacagcagagattcagaatatagtgggaactggagtcccaggtcctccatggagttgctggaggccagctatcgggcaagctgcagatcccatggagatggctgagggcacgtttggcaattttacattctaggtcatctcagccatgtgatgggaaaaggcttcagtcccagcagatcaccaggattggccttcacggagcggagggctggagagttgaggatgagaagtgaatgtagggctgtgtcaaggggaagtagaaatccatgatgctattctttaaaatcctgaagttggccaggcggggtggctcatgcctgtaatcccagctctttgggaggccggggtgggcagatcacttgaggttatgagttcgaggccagcctggccaacatagcaaaaccccatctctactaaaaatatacacgcacaaaaaaaattagccaggcatggtggcacacacctgcaatcccaggtgcttgggaagctgaggcatgagaacatagtgagaccctgtctgtacaaaaattaaatttaaaaaaattagctacaagtagtgatgtgtggctgtagtcccagctactcaggaggctgagtggggaggatcatttgagtccacgagttggaggctgcagtgagctatgatggtgtcactgcactccagcctgggtgacagtgagaccctgtctctaaataaacaaacagaaaaatgatactgtgtctcaacaattgacaaaacaattacactgtattaggtattataagtagagatggcttaaagtgtatgggaggatatgcctgggtgatatgcagatactgcatcgtttgctacaaggggcttgagcatccttggattttgatatcagtggaagtccgagaaccaactccctgaggatattgagggccagctgcacacacagatgagaaggaattaggccactcagtcagtcttctccgaaagaagtctttgttctgccaaaaagacaaagccggtgtgttctcaggctggcaagaccctcccacttctctccctcggggagagcagacctgggtacctaccacctttgagttgatgttctctgcctatagcccttccccagggctctctgccccagccccctcctcctccaagccagcacaggccatgcaccccctcctctgcgcagaagagcctgggatgcagggggaacagtcagagaatagtctaaaccacgtgcaaaaatgcaggcctggtgacttctgccccttggggcggtcttcccacatgggactgtttgtgccatgtttggtcttttacccatgtggttggagatactttgagtacagggtcaaagggactcatttccacgtgcctgtttttgtcttcagcaaatggctggattccctgtttaggatctgggggcatctcgctcttgcttccagctctccagtgcatggatactttcctaaaagtagacaaaatgtcagttctttccaaattcactgcagagaatggaggagaacagagtagccttcccacatggagaagttttctcttttacgcccagcgcccattgcattgacacagacagtttcggtttcccaagaaaacgttttcaagctgccttcatgactccttggaactcaaatgcgcagctcagaagccgcgggatgcagcggatgcgtcactagaggtacttgaaaacttcagtaacacgcttatcctaaaggagaagaaatggcacagaaaagtatgctaagcgtcccactcaagaagttagaaaaggaacagcagaattacccagaacagtagaaggaaataagtgaaaaccagtagaattcacaaattagagaagaaaatgagagaagatggaagtagctgaagttagaaatctttttaattttagtgaaattaattttagtagaatcgcctcttttaagtgttaaaaagcatttaagcatttaattgcttcttttaaatgttcatttaaataaaattagttgaattatatttaattacttatttgtagtacattaactagtttttttattttatgtattttaaatacaattagctttttattttttattaacatttaattttaataaacttcattttactttaaatcaaattttaatttataatcaagttaaaaataaactacaataaaaagagtagaatgaataaaatctggtaagattgcagataaaaagaccagtctggccaaaatggtgaaaccctgtctctactaaaaatagaaaaaaattagcccggcgtggtggcaggcacctaatcccagcttctcaggaggctgaggcaggagaatcacttgaacccaggaggtggaggttgcagtgagcagaggtcacgccattgcactctagcctgggcaacaagagcaaagctccatcatacacacaaaaaaaacagaatatgccaatgaataacattatgaagaaaaaagaaatataactccagatgtagcagagtttataaaaaaaataagatgatattaggaataactatcgcaatgtgtttaaaaacttcgtacacaatggacacattcatagaacaatatatttaaccaaactgactcaagtagatatagaatatccaaatggtattgtagaaatttaatacattgaatgagtggttaaaaagcttctcactaagaaaatgctagacctaactggtattatcaggcagcagtaaattcaagtattatttaagctccagcagacaaaacacaaagaagcaacatatgcaaactattttgaggccaagaatattttgatattcaaactcagcaaactcaacaaagaaagcatgggaaaagaaattatagaccaatctcactctttgtgaggtacaaatgttaggcaagtttcaacaatagacaatctatgattgtactttaaatatttacagattaaaggagaaaagaaaacaaaatggaaacaaaatatttcttgtatcaattgatacagaaagtagctgtgataaaactgaacacccattcaggatttaacaaactaggaataaatacaaacttccttaatctgataaaagctttctacggaaaaatgtatgtcatactaaagagtgggatattaaaagtggtctccttaaagtcaagaacaagttgggtgtggtggctcacgcttgtaatcccagcactttgggaggctgaggtgggtgggttgcttgagcctaggggtttgagaccaacctgggcaacatagtgaggccccatctctacaaaaaatacaaaaattagctgggtgtggtggcttatacctgaagtcccagctacttgaaaggctgaggtgggaggattgcttgaacttgggaggtcgaggctacagtgagctatgatcatgccactgcactctagcctgggtgagagagtgagacctgtctcaaaaaaaaaaaaaaaaatcaagaacaagtcaaggaagaacattcagaagaggaaatctaaattacaaataaacaaatgaaagctgctcagcttcagtagtagtcagggaaggaaagttaaaaccacagttgctatctcccagtaccaaagctgagcagacagagatgcactggaatatgtatactctgctggtagatgtggaaaatattactgctgctttgaaaaaccatgtagaattacttagtaaagatgaggatgtgccaatgacacagcagttccactctggtttcttaccatagaaaatcttgtacaaatgtgtaataggaaatatacatgaaattaaattgcttatgatgtcattgcttatagtattacaagatgggtgtattagtccatttccacattgcagataaagacatgcctaagactgggtaatttataaagaaaaagaggtttaatggactcacagttccacatggttggggaggcctcacaatcttggcagaaggcaaaaggcacgtcatatatggtggcaagcaagagagaatgagagccaagtgaaaggctttttccttataaaaccatgagatctcttgagacttattcattacgatgagaacggtatgggggaaactgcctccatgattcaattatctcccatcgggtccctcccacaacatgtgggaattatgggagctacaattcaagatgagatttgagtggagacacagccaaaccatatcaatgagaaacaatccaaatgttcatgatgtttaaaaaaatgtgggatattcagatcatggaacaatatgcagcaaagaacaacagaaacacagctacctacttcagtggtgtaattcttgaaacaatggtgaaggaaatagcttgaaaaaaactccatacaatgtcattatgattatatagagattggaaacaagcaaagtggggaaatgcaaattaaaacaacaatgagataccaatacacatctgtgagaatggccaaaagccagaacactgacatcaccaaaagctgatgaggtcgtggagcaacaggaatgaccattcatggctggtgggaatgcaaaatggtacagtcactttggaagacagtttggctgtttcttacaaaactaaatatgtcctggcatatgatccagcaatcactctcaatggttacccaaaagaattgaaaacttgtgtccacgcgaaaacctgcacatggatgtttacaacagccttatttataattgtcaaaacttggaggcaaggaagacgtctttcagtaggtgaatagacaaatagaccatgttgcatcc[142 bp omitted]aaaaccccatctctactaaaaatacaaaaattagccagcatggtggcgtgtgcctgtaatcccagctattcaggaggctgaggcaggagaatcgctggaaccagggaggcggaggttgcagtgagcctagatcgcaccactgcaccccaggcctggctgacagagtgagactctgtctcaaaaaacaaaaacaaaaacaaacaaaaaacaggccgggcatggtggctcacgcctgtaatcccaacactttgggagg[135 bp omitted]gaggcaggagaatcgcttgaacccaggaggtggaggttgcagtgagccaagatcatgccactgcactctagcctgggtgacagaacgagactccatgtcaaaaaaaaaaaaaaaaaaaaaagagtaagatgacagcaagaatgagaaaaaaataataaaaaatatatatataaagaaataagggtcagatgtggtggcttgtgcctgtagtcccagcactttgggaggccaagggagaatcccttgagcccaggcgctcgagaccagcctgggcaacgtagtgagatcctgtttttataaaacattttaaaatgtggtggtgtgcacctgtagtcccagctactcaggaggctgaggtgagaggattgcttaagcgtaggaggtcaaggctgcagtgagctatgattgcaccactgcactccagcctgggcaatggagtgagaccctgtctcaaaaaaaaaaaaaaaaaaaaaagagaaaaaaaaagaaacaaaggaaaaagaagaaaagagaaaagaaatgagctataagccggacatattactaattgaaagaagacaatccaaaagggctacatgcgattctaactataggactttctggaaaaggcaaaactatgagacagtaaaaagatcagtggttgccaggatgtgggaatgaataggcggagtacagaggatttttagtgtagtgaaactcctctgcgtgacactatagtggtatatccatgctattatacatttacccaaacccacagaacgtccgccaccaagtgtgaacccgaaagtgaacgatgggctctggtgtcaatgatgtgtcaatgccggttcatcagctgccacagacagcaggggaggtgatgcatgttcagggtagggggtccatggaactctctgtaccttcctctcaattttgctgtcaatctaaaactgctctaaaaaataaaatctactaaaaatgtatacatatgtaacaaacctgcacgttgtgcacgtgtaccctagaacttaaagtagaataaataaaaataaaaataaagtaatatatcagaggttgaaaaacaacaacaacaaagacaaaaaaaaaaacacaggccgggagcagctcatgcctataatcccagcactttgggaagctgaggcgagattattgcttgagtccaggagttcaagaccagcctgggctacgtaatgacaccctgtctctacaaaaacaaaaataaaattagccgggcgtggtggtgcacacctgtaatcccagctactcgggaggctgaggcaggagaatcgcttgaacccgggaggcagaggttgcagtgagccgagatagtgccactgcgctccagcctgggcaacagagcgagactgtctcaaaaaaaaagtgactcaaacatgtgaaaagatgctcaatcttactcatgatgaataaatttttttaaaaatgaatgctacaaatatatacaaataaaaatattatcctggcatggtggtgctacctgtagtcccagctacttgagaggctgcaatgggaggatcgcttgagcccacgactttgaggctgccgtgagccatgatcgcactattgtactccaggctggggaacacagtgagaccctgtctctaaaaaacagcacaaaacaaaaacacacacagacaacataatatacagtgtagagatgagacacatcactaaactatatataaaacaaattgatgaataacataagtggttaacataaattctgggttgagagaggcacacaaggcccttttgaggtatgggatgcatgttttgatttaaattgcatttatgtaggtgttcgttctattattcttgaactgtacaaaatacgatatactcacccatgagtgaaaggaaaagaaaataattctaccagctgatttactcacactgtagtgatgggactttttcagcaattttgatgtcatgtgattgcgtcaagaagtcaatcagaatttcagaactggaacagaccaggaacaaagatatccatgaagaaaataacctcaaaattacagtcagtggtaggactgttgagaaccagcttgtttttttgtttttgtttttgtttacattttcccaccctgttttgtgacgcaacacatcctagataccagtggacatccctcaaaggtgttaactttctctactcaagaagacaagtggacttcatgtcatgtgaagctattttaaaatatcttgtccttttaagaatgaaaacaacttattttatgagtccatttattttatttatttttgagacagggtctcactctgtcacccaggctggagtgcggtggtgccatcacggctcaatgcagcctctgtctcctgggcacagatggtcctcccacttcagcctcctgagtagctgggactacaggcatgcaccaccacacctggctatttaaaaaatatttttgtagaaatggggtcttgctatattgcccaggctgatcttgaactcctaggctcaagcaatgtacccacttcagcctcccaaagtgctgagattacagatgtgagccactgcacctggtcatccattttaattattttcatgtacttaatgaaataacctaaaattcaactaataacccaaataagacatactatcaggtcttggtaagaaatgagagtcttagctggacacggtggctgatgtctataatcccagaaatttaggaggctaaggtgagatgactgctcgagcccgggagtttgagaccagcctgggcaacatagtgagacccgatttctacaaaaaaatacaaaaacgagctgggcatggtggcatgtgcctgtggtcccagctactcgggagatggaggtgggaagatctcttgagcagggggctaaaggctgcagtgacccatgatccagccactgcactccagcctgtgctacagggtgagaccgcatctcaaaaaaaaaaaaaaaaaaaaatgagagtcttaccagcctgaccaatatggtgaaaccccatctctactaaaaatacaaaaattagccaggcgtggtggcgcatgcctgtaatctgaggtagagcctgaggcaggagaattgcttgaacctgggaggcagggg[135 bp omitted]tgattttcaagtggcactttaaagacttccttaattcttactatttccttgtaaaatttcagagtctaaaatgcattttatagagtaaaagtaataaaaagtgaattcatttctacaccaccccccaatctaatcgtcttcgttctctctttcacactttctctctctctctctctctctctctatctatctatatatatatatatatatatatatatatatatctcttacgtacatattctgtttagtcctctcaggcactaatttggacgtcatctttatcttcctcttgttttttacaatgcagaatcggtcaccacatcctcttgactttgcttttatcagcaccatcatggtggagactttcctgtctatctctgtcattcatctcctgcccaggactacttcagcccatgaccacagacttgccatacccttcctgtagctttctctttaaagcgtcaaccccaccccccaccacagcttccagaatcatttttcttagatattgctgaggtcatcatgcaattaattactcagaaaagctttctggttccgttggtgaaaaatatagagctgggagctaaatgacaagaactcatgaacacaaagaaagaaacaacagacgctggggtctacttgagcggggcgggtgggaggagggagaggagagaaaagatcaccattgggtgctgggcttagtacctgggtgatgaaataatctgtacagcaaacccctgtgacacatgtttactgattaacaaacctttccat[136 bp omitted]catggtgaaaccccatctctaccaaaaatacaaaagttaaccaggtgtggtggtgtacgcctgtaatcccagctactcgggaggctgaggcatgagaatcgcttgaacccaggaggcagaggttgccatgtgctgagatcatgccagtgcactccagctggggccatagagtgagactcagtctcaaataaataaataaataaataaaagatagaacatgggctgggtgcggtggctcatgcctgtaatcccagcactttgagggaccaaggtgggcagattgtttgagctcagacgtttgagaccagcctgggtaacatagtgaaaccttgtctctaaaaaacatacaaaaaatagccaggtacggtgcagcacacctgtagtctcagctatttgggagtgagtggtaggaggattgcttgaacctggggggttgacgctgcggtgacctgtgatcgtgctactatatttcagcctgagcaacagagtgagaccctgtctcaaaaaaaaacaaaaacatatatgtagagagagagcatccctggtgtagtgaacactgtagtgtgctactcagtccctgctatgaacatgagtgcgtatgtactgttttgcatctcactgcttttatttctttggggtacatatttgggagtgtcagactttttcttaatcttattttttctggcacattatctcacctttactctcagctctctccggcgtccatgaatctagatctttgcttattcatcactggttaaaattacaagtaagtttgtccaagttgtcgagatgtgttcatctggctgcaaggagtaggaggagaattcttctgacaagcactgctgtgcaaagctcctgtctccagccccgcctgtgtctgcaccttgagagccacctgctgtctcccattcctgagatggttaagatttctgggacttcttgttgggttgtcctgtgtattgccatgagttcattgcctccatctccgtcctgcctgccatgacagttactgctagcttagagtcctagtccatttgggctgggaggcttgtagacaacagatgtttattgctcatggttctggaggctggaggtccaggagcaaggtgtggcagattcagtgtctggtgagggcttcctggttcatagatggcaccttctcactgtgtcctcacatggtggaaagggtgagggagctttctggggtcccttttctaagggcactgatcccattcatgaggccccaccctcatgacatcagcacctcccaaaggtcccacctcctaacctcatgactttgggggttagcatttcaacataggaattttgggggtcacacacattcacaccgcagcatccatctgcctccaagccttctaaaggtcatcctcgtcttttgtctgctgagggggaaaaagagagacagacacccatgcgcgcgtgcacacacacacacacacacacacacaaacacacagcaaagataaactattttgttaaatttgctatgtgctatgtactatgtctaacagtaagtcctggttatttgttcataaacctgcatttcccattagactatatcatctggaaaggagaatataatgtttccctcagcctttttatttctgactctcagcatactgcctcaaaacaggagcgatcagaacgtgttcattaagtaggcagacgtgtctcatcaatgccaatgttaattagcatctagaggtccaggtatctctcctactgcttaaacatgctacatcgaaaattagagaaatgaaaccaagcttgcttctatgtgtgagaaaagaggggataaatggcttgaaatgagaatgatattttttctctttttcttgagacagggtcttgctctgttgccgaggctggagtgcaatggtgcaatcatgtctcactgcagccttgacctcccaggctcaagtgatcctcccacctcagccccctgagtagctgggtccatgggtatgcagcccctcatcaggcaaattctttttgtatttttagtagagacagggttttgccatgttgcccaggctggtctcaaactttggactcaagagacctgcccccgcttggcctctcaaagtgctgggattacaggtgtgagccaccgcgctcagcctgaaatgagaatgttttactcaaatataggagaacctctaagtttctgggtctccatgagactgggaggaaaatggctcgcattgttgtgacatttcagtgtgtgaagggggaagagaaaagactctagaatagtgggggctggggaggcggagggagaaagacacagagcgagagaatgacagagagagagagtgacagagtcatgcaaaaagagagaaaactgagtgggagaaagaatgagagagaatgacagagtcatgcaaaaagagagagggaaagaagagggagagaaagagagagattgtgggagagagaatgagagagaaagagaatgacagaattatgcaaaagaagagagacggagagactgggagggagaatgagagaaacagagtgggagagagaaagagaatgaaagagagaataagagagagaaagagagaatgagagagaaaatgagaggccgggcacagtggctcacgcctgtaatccaggcactttgggaggccgaggtgggtggatcatttgaagtcaggagttcaagaccagcctggccaacatggtgaaaccccatctctactaaaaatacaaaaattagccgggagtggtggtgtgtgcctgtaatcccagctactcgggaggttgaggcaggaaaatcatctgaactcgggaggcagagcttgcagtgagccgagatcgtgccaatgcactccagcctgggggacagagcaagactccgtctaaaaaaaaaaaaaaagaaaatgagagagagagagatgcaaagggttgagaaaaaataaaaaagggattcgactttgcctcaggctcagcagcactggaagctcaatagtaacagtgatgccttcaccattttggggggaaatgtctaggattgcatacacaacccagccatgccacatgagggactgagcatgaaggctggagctcacgtagctgcagaatgcctcttaacggtaacccccatgcactcttgctggtaatgtcttagaaaactggatttgaggaaatgagggcaatttgagcatgagggagacatggaattcaggaactgatgcagctaacgtgaagaaatttggggggaattttcaggatgaccataaaaataacatcctgcacacagtgagtagggagctagccttaacattttacaaccacgatcacatttaatgcacgtgactattattattctcattttccaaccagtcatggaaactgagctgcagagacgcagacttatctgatcaagataccacaagaagcaatccaggctacaaacccaggctgtttggaaacgggatgtcctggggacagtagctctgggggtgtcttagaaagccttgaatccaggttggagaaggaagttgtagggtcccaggaggctgtgttcaccatcatgatgtgactaccttaggtgttaacggtatttggaagggattttcagtctcgtaataagtctgtgaaaagaattttagaaggcaaaccatgaacagctagcaagcttaggaaattcaagaatgtatacaaggaagggaagttaggcacatctcagtatttagagaactcacataatgtaagtttgggtattcatttagtaaacattggtgatgtagccatatcaggaagctgaatagaaaggaaatgtgtgtgtgtgtgtgtgtgtgtgtgtgtgtatgtgtgcaggcacttgagggaatggtgattgggcaaaaaacgaaaagccatcatcctacaaacagaaagttaatagataccatctaaagttaagaaacacaagagatttctgggcaaatatgttatttcaaaatataaagtagatcccagaaaaaaaataggagtgaaccttgagggcaagacataagcttaaggtttggcttcatcttttgagctttatacatgtatcactttgacaagaataaaaagaataaaaactacatttaaaattagaggccagtcatggtggctcacatctgtaatcccagagttttagaggctgaggtaggagcatcgccagaggctaggagtttgagaccagtctgggtaacacagtaagaccctgtctctacaaaaaaattaaaattggttttgtgtatgatggtatgtgcctgtggtcccagctactcgggtgggtgaggtgggagaaaacttcagcccaggagttcaagagttcagtgagctgtgattgcaccactgcattccagcttgggtgacagagtggagaccgtgtctctaaaataaata[133 bp omitted]ctcccgagtagctgggattacaggcgcctgccaccatgcctggttcatttttgtagttttagtagagacagggtttcaccatgtttgtcaggctggtctcaaactcatgacctcaggtgatccgcccgcctcggcctcccaaagcgctgggattacaggcatgaaccaccgcgcctggcctattattttttctttccaacttttatttccggttcaaggggtacatgtgcaggtttgttgcatgggtaaattgcatgctgtggagctttggtgtacagacgattttattgcccaggtaatcagcataatactggataggtagtttttcaatcttcattctcctcctaccctccaccctcaagtaggccctagtgtctatcatacccttctttgtgtccatgtgaactcaatgtttagttcccagttagaagtgagaacatgcagtatttagtattcagatcctgcattaatttgcttaggataatggcctccagctacatccatgtcgcagcaaaggatgtgatttccttctttttcatggctgcataacattccatggtgtgtatgtaccatgttttctttatccaatctgtcatttatgggcattttggttgattccatatctttgctattgtgaatagtgctgcaatgaacatacatgtgcatgtgtctttatggtagaatgatttatattcctttgtgtatatacccagtagtgagattgtggggtcaagtggtggttgtgttttaagtcctttgggaaatgtccagactgatttccacagtggctgaactaatttacactcccaccaacagtctataaatgtcctcttttctctcagctttgccagcatctgttattttttaacttttaataacaacttagatgacaactttaaatttaatttaaaatttaattttaatttaaaattaattttaaaatttagactctgacaaagttccatgtgtaatttttgtaaaaatacaaaatttagcagggcatggtggtgtgtacctgtggtcccagctagttgggaggttgaggtggaaggatctcaggaagtcacggctgcagtgagctatgatcacaccactgcactccagcctgggtgacagagcaagaccttgtcccccacccccaaaaaaggtatattatccactttaaaatttgattaaatgattaaacaacacaggtcaattgatttcatttctgtgttgtcaaaaataacagctgagtttgctacgttaaaacgaagcaagaatttttgagagcttggaattgcgtggtggagagttcaaaagcagcgagatagcttctgtgtcatcactgctgatggaaattggctcttcgtgggaaggtggagatgcaggaagaaactagtgagaggcattctgtggtccttgaccaagggctagaagcattacccccatagagaggggacttccacacagaagcttggtgatgttggcagaataatgttactgaaggacatccataccctaatccctggaactagtggctacattcccttacatagtcaaagggactttgcagttgtgacaaagttaaggatattgagattgggggatgatcgtggataatccacatatgtccaatgtcatcacaggcatccttataagagggaagtaggaggtcagagtcagagacgaagacatgaggatggaagcagaggtggaatgatgtgctttggagataaaggaaggggccgtgagccaaggaatgtgggtggtttccagaatatgggaaagctaaggaaattaattttacccctagagcttccagaaagaaccagttttgccaacatcttggtttcagcctatgatgtgatgtgaatttttgtccccacctgtatcagttccttctcacactgctaataaagacatacccaagactgggtaatttataaaggaaagatgtttaattgactcacaggtcagcatggctgggggcttcaggaaacttacaatcatggtggaaggagaagcaaacacatccttcacgtggcgacggccaggagaagtgcagagtgaagcggggcaaagtcccttataaaagcatcagatctcatgagaagtcactcgctatcatgagaacagcatggaggtaactgcccccatgattcaattacctcccactggctccctcccatgacacctggagattatgggaactacagttcaagatgagatttgggtggggacacagccaaaccatattgccacccaagtcggctgttgaatggtaatccatggtgttggacgaggggcctggtgggaggtggttgaatcataagggcatttttcccccttgctgttctcatgatagtgagcgagttcacacaagatctggttgtttaaaagtgtgtggcacctccacctttgctctcttcttccttctccagccatacagaatgtgcctccttcctcttcgccttctgccatgattgtaagtttccctaggcctccccagccatgcctcctgtacagcctgcagaaccgtgaatcaattaaacctctcttctttataaattagccagtctcacgtagttctttttagcaatgtgagaacagactaatacagcctgtaagacccattctgaacttctgacttacagaactgtaagatagtccattgattgtgttaagtcactaagtgtgtgagaatttgtaacagcagcaatgggaaactcgtatacttggtgtttccaactcattatgctgatgatgcctcccaatttgagcaatccaatcttgaattgggctacagctggtttccctgtcactgccccattcaacaatgtagatgtaggaattgttgggccaggcatggtggctcatgcctgtaatcccagcactttaggagactgaggaaggtggatcacttgaggtcgggagttcga[135 bp omitted]ggatgaagtgagctaagatggtgccatcgcactccagcctgggtgacagagcaaaactccatctcaaacaaaacaaaacaaaaacaatgtagatgtaagaattgtaaattcttcatctttttcttttttagagatgggttcttgctatgctgcccaggctgagctcaaattcctgggctcaaaggatcctcctgcctcagtctcctgaatagttgggaccagcacctggcttgtaaattatttgtttcagttattttgcttaaatacattattatatttattcttttcaatatttcttttctacatatttctttttttgagatggagcctcactctgttgcccaggctggagtgcagtggtgcgatcttggctcactgcaacttctgcctcctgggttcaagcaattctcctgcctcagcctcccaagtagctgggattacaggcgcccaccaccacacccggctaatttttgtatttttagtagagatgggatttcaccatgttggccaggctggtctcgaactcccgacctcaagtgatccaccttcctcagtctcctaaagtgctgggattacaggcaggagccacagctcctggccttcttttctacatatttctatattctttttttcttctgtatattcttttttttttttttactttaaaacacatttatattggcatattcttcttttaattgacaaatcaaatattgtatgtatttatgatgttttgatacatatatccactgtggaatggctaaattgagctaattaacattccctaacatagttatgttttcgtggtgagaacatttaaaatctactctcatagtaattttcacttaacagtgaatgtcttcaccattcaccgccgataaaatatattgttatttactgtggtcatcatgctataaaatagatttcttgaacttatccatcctgtctaactgacattttgtgtctttttttgagggggaggttctttttttacagacatggggtctcactctgttgctcaggctggagtgcagtggtataatcatggctcactgcagccttgaaatcctgggcttgagattcccctgcctcagcctcccaaatagctgggaccacaggtgggcggcaccatgcccagctaactgaaatttgcttttttggcagaggtaggatctcactatgctgcccaggctcatttttttgtcattcaccatatcttcagtgaatatatttgctatttgattatatgtggcaggatattgctctgtttgactagctctctgagggtggttagtgtgacccagcacagatgctcagtgaatacgtcttcatgagttcagttacacttgaaggtgggtgatgataaagatgtgacttaataccccatttctgatgtaacattggacatctttggaaggaactttgggaggcagctcattgtaacaagaagatggacttacaataagataagatatggtctgattagaggaatgcaaatcaaaaccacaatgagagaccatctcacaccagtcagaatggcaattattaaaaagtcaaaaaccaacagaagctggtgaggttgcagaggaaaaggaaggcttttacactattggtgggagtgtaaattagttcaaccattgtgggagagtgtggtgatttctcaaagatctagaggcaaaactatcatttaacccaccaatcctattgctgggtatatactcaaaggactgtaaattactctattataaagatacatagacgtgtatgttcactgcagcactattcatgatagcaacaacacgggatcaatccaaatgaccatcagtggtagactggacagagaaaatgtggtccatagacaccatggaatactatgcagccataaaaaggagtgagattatgtcctttgcaggaatgtggatgaagctggaagctgttatcctcaggaaactaacacaggaagagaaaaccaaacactgcatgttctcacttataattgggagatgaacgatgagaacacatggacacattgtggggaagagcacactctggggcctgttgtaagggggcgcagggggagggagagcatcaggaagaatagctaatggatgccaggctcaatacctgggtaatgaaatgtacatgaaaaccataatgagttgctatctcatgccagtcggaatggcgattattaaaaagtgaaaaacaacaaagcagcatggcccacgtttgcctctgaaacaacctgcacagcctgcactgatacccccggacttaaaataaaagttgaaggaaaaagaaaaagcatatggtctgactacctggggccactttctagttgacgtgatattatccacagtaattcacttggctgggtctcagaatttttgcctgatgagataacagtggttacttcagagagttttgggggaaaaagcatataggctactgtgataggtagaataatgattccccaaagatgtccacatctgaatccctggaacctgggaacagctgatcttgcacggtcaggaggactttgcagatgagatgaggttaaggatcttgagatgggagatgcccctggatgacccaggttggccctaaatgccgtcacaggctccttctaagagggaggcaggagggtccaagttggagaaggagacatgaaaatggaagctgagatgcgagtgagggagagccatgagcttggaaacgctggaagctaaagaaggcaaggaatcggatcctccccacagcctccagaaagaaccagcactcctgggtttcataagagacagaaactttctctgtcacccaggctggagtacagtgctacaatcacggctcactgcagccttgagctcctgggctcaagcgatccttccacctcaccctcccaagtagctgggactacaggcaggcaccacaacactcagctaatttttagtatttttttgtagacagggagtcttgcatattgcctaggctggtcgtgaactcctagcctcaagcaatcctcctgcctcagcctcccaaagtgctgggattaccagtgtgaaccactgtgcccagtcgacaccttaattttatctccatgagcctcgtgtggggcttctgacctctaaaactgtaatacatttgtttgtgttaggcacatacgtttgtggtgattttttacagcagcattataaaactaacatggatttcatttgggaatttgggaaaagctcatttattgcctaatgtagacaagcttcttaataaatggtaggtcccccccttccctcccttccttctttctttttgaaagacaaacccccctatgtattataggactctgaatattagatcctatgggaaaaaatgatgatggttatataaataataacccacttattttcttctcatctttttgccaagtataataaattgatcttgacgtgcaaatgcatgagaagcatgattttcgtgcccattcatgattagtatacttttctggtgctcagtaattttaaagtgtttcactctgttttccccaaagacaaacacactaagatcacaagaaagaactacatgcttttattctctgcctctgagctaaatccactggggtatttgcctggg[132 bp omitted]gcaacctctgcctcttgggttcaagagattctcccacctcagcctcctgggtagctgggattgcaggcactccaatacacctgctaatttttgtatttttattagagacagattttcatcatgttggccaggctggtctcaaactcctgacctcaggtgatctgcctgcctcagcctcccaaagtgctgggattacaggcatgagcgaccatgcctggccctattaatttttatttattgctcttatttttatttttattttttgagatggaatcttgctctgtcgcccaggctggagcgcagtggcatgatctcagctcactgcaacctccacctcccaggttcaagcaattctcctgccttagcctcccaagtagctgggattacaggtgcccaccaccatgctcaactaatttttgtattttttagtagagacagggtttcagcatgttggccaggctggtctcgaactcctaaccccaagtgagtcacatgcctgggcctcccaaagtgctgggattacagccgtgagccaccgtgcccagcctctattaatttttaatatatcctggattgtgggaattaatgaattctaggtaagaagcacaaaaatttagacagccttggaaatgtcgtcatgattccttgcattggatatattgagtgtggccaggtctgtggccttattttgggtgaattctgggttgaagtccagctgaatggactaaagccgttttcccatttaaggggatatcccatagtgatatcagcccctgtgttgtaactgaatttcaggttcagtcactcactgctggcagagttcaattaacaagagtgaggtctgataaagaaagtgactttttattccaaagctagcttaggggaaggagtacatgcttcctgccttaagagtactgctttgcttctggcacagaaagtaggggcttttttttttttagacggagtctcgctctgtcgcccaggctgcagtgcagtggcctgatctcggctcactgcaagctccgcctcccgggttcgcgccattctcctgcctgagcctcctgagtagctgggattacaggcgcccgccaccacccccggctaatttttgtatttttggtagagacggggtttcaccatgttggccaggatggtctccatctcttgatctcgttatccgcccaactcgacctcccaaagtggtgggattacaggtgtgagccaccgtgcccagccctataattgcatttctaaagagctaagtaggaagtgatgaacaggggaaaaggagaaaagacaaaaaagaggaaaaaataattttaaaaactcattctctttctctcaggaaaatgggggtaatggcc[178 bp omitted]gaggcaggagaatggcgtgaacccgggaggcggagcttgcagtgagccgagatcaggccactgcactccagcctgggcgacggagcgagactctgtctcaaaaaaaaaaaaagaaaagaaaaaaagaaaaatgggggtaacgggttacaatgtgaccttcctatgggaagggcaagttgcagtagtacaaaatgcagacttgtgccttcgggtgccccctgcaagggtgcattacagaactcatgaaaggaacagcccaggtacctgccgagcacatagactcatggaggaagcagcagaacggtttggaggttacaccctttctcattatttcctctaagccttttatcctaaaggcatgacctattttggaaatgaatgtggagacaaatgccaattttggagacaaatgccagcttcttcagttaggaactcagccagtctgggcttgtgcagctaagagactaatggcatggaatcttcttagcttgtaggttaaatgctgctaagtggagagagagtctgatgtggagcttggaagaagcctttgcaatgtcacctcgggattccctggggccaatcatttaaggcactggtgagtccagtccattgtcttgaccttcccttgctaatgtttgggggttttgtcatgttttctgtttgtcacttagaaacgaggcacaatgaaaagaggtcaaaccaaatttgttcagttttgttacagctgtggtagatgctaaggaatagaaggagtaaaaatgagggaaaggaggggaattttagatttctcatagattttaattctgcacattgtcattgttttataagcataaatgtacatgtgcatacacacacatacacacacacacaactgtaactgccatgcatccacccacacatttattcatccatccatccatcattccatccatccacccacctacttacccatccatccatctatccacccacccatccatacatacacccaccctctcacctacctatccatccatccatccatctacctatccacccacccatctatttactcacatgcccacctacccctccatccatccatccacccacccatccatccatccacccccctacccatccagccagtcatctattcacccatccatccagccatccatccatccacccaccctctcacctatccatctatacatccatctacccattcaaccatctatacacatgcccacctatccatctatttactcacatgcccacctacccctccatccatccatccatccacccacccacctatccatccaccctctcatccatccatccatccatccacacacccatccacacacccatatacccatccatccacccatatgcccagctatccctccctccatccatccgcccacccatccatctacctatccatccacccactcatccatccatacatcattccatccatccacccactcactcatctagccagccagccagccagccaaccagccacccaaccaaccatcattccatttaaccattaatccatctaaccatccatccatctattcatccatccacccactcatccattcatccatccatccatccatccatccatccatccatccatccatctaaccagccagccagccaacaagccacccaaccatcattccatctatccacccacccatgcacccagttacccatccacttacccatctatccatcatttcattcatccatccacacatccatgccactcatcctcctacctatccatccatctattcatcattccatccatcctttcatctccccatctatccagccacccatccactcacccatccattcatcatttcatccatcatccacccatccatctaccaccaatttgtccatcattccatccatccatccatccatccattcactaacccatgctactcacccacccacccatccactcacccatccattcatcatttcatccatccacccatccatctaccaccaatttgtccatcattccatccatccatccatccattcactaatccatgctactcacacacccacacattcacccacccatccaactattcatcattctgtccattcattcacacacccacactactcacccactcacccctctactcatccacccattcaccattccatccatcctttcattcatccgtctatcattcatcctttcattcatccgtctgtcattcattcatctgtctgttattcattcatccatccacccatccatctttctatccatctttccatttgtccatccatctagccagccagccagccagccagcaagccaggtatccagccagccagccagccagccatctacctacctcactcacccatccatccatccatccacccacccattcatctgtccatcatctatttatctatccatccatcaatccatctgtcaatctatctattttgtatgtttgaggagaccaaaattgagttccttctgcctaaatgggaaagcaagtttttatccctccaggcccctgaatagaaatgagaatgcttccatttctaaaccaaggctttggaagcatttagcaccatcagggaatggggagacatgggaggctgatgatcagcatgacaggcttctggttctctgtcccgatggtctcctctgtgcaaaactgactcttgacttttcacctcagtttctaagacccaccgtgatctgagcaacatgtaacatcaaaaatccagtttggtggctcatgtaggtcaacaggaaagtcatctttagctactggtcttccttctgcttttccctcttgcttatgtaattgtgccccacacaggtttgtatgtccctccactctttcctcaaaaattcttgccatttgatgtcctaggctaaactttaaaaaattgtggtaatatgtacatcacataaaatttaccaattacattatttttaactgtacaatttggtagtattaagtgcatttacattgttgtgcaactatcaccatgatctattttcaaaacactttcttcaccccaaacaaaaatcgtgtccccattaagtaataatttttcattttccctccccaccaacctctgacaacaaccattctgcactctgtctccaagtatttgactcctcaaaggacttcatgtaagtggaatcatatattatttgtcttttcatgacgggcttgtttcacttagaataacgtcctcaagatttaagtatattgtagcatatgtcagaattctctcccttgaaggctgaataatatttcattgcattcatatactacattttacttatttattcatctatggacatttgggatccttccatcttttggctattgtgagtaatgctgctatgagcacatacaaatatctctttgagatcttgctttcaatatttttgggtatatacccagaagtggaattctattttcagttgttttagggaactattaatactatacttccctaggcagggctttgcctgtgtccatagttgctccaatgtgtcctcactcttatgaacctgtcctgcttccaggttccaacctactgggcttgatcaaggacaggaccaattcctattcagattaatgaggattttcttattcaaaaccatcaccaaggactatgatgaataaattgatgatggatacatgcatggtagatggatggatgaaagatgatggatggatggatggatggatggatggatggacggacgaatatattggatgaatgtatggatggatgagggtagataatagatgaatgggtagatgggtgatagatggttggatagatgaatagataatgaattgatggatctaggatggatgaatgaatagctaataaatggatggattgttagatgtatacataaaaggatgacagatggatggatggatggaatggatgatggaatacggatggatggatggatacacagatgaatgttaggtgaatgaatggatggatgaatatatagatggaacatggatagcctcatggaaaaagaaccagagttctaaaagctccaggtctggccctgacactaatgttttgtccctgtgtaattaatttaagcaaatccctttgtgtctaaattgtgatgtcggacaaggctgtatagaaaattgtgtgtttgtgtatgtgcattgttcatacaggaacatttgcgtgccaatgttggctggggcccctggcaccctgaggtggagatgaaattgtctcaagctcctatttttacttctcatgaaaattcaaatctgtttcccaatttctgtgacttccttggaggctggaaggaacgttaccttcttatagaagccctgtactctggatttctgcttccacacacacaccccagaatctgtaatgaaagccaacctcttctgcaactttcaagcaaacacaccacactgatgcagccttcccagtgtagcataacaaacacagcaaaatacagtggtgagggagaaagcagggaatgagtttacaacgcattatcctgtttctcacccctctttggctccctggaatttccttcttgctgttccttcactgattttgaaaatccattcagccctctccagcttctgctcccaaaacacacatccagcccactggggtacccagtgaaacatcaaggtttccattcaagtcgattctctcttcttcaaaggtagttgtggttctgaaagcggcattcttctttttcctattttctgtgtatgtttccaatagactgtcactgttaggcaaattagccttaaaatcaaattgaggctgggcatggtggctcatgcctgtaatcccagcactttgggaggctgaggtaggaggacttcttgaggccagaagtctgaaaccagctggggcagcatagtgagaccctgtctctacaaaaaattacaaaataaaaattagcctggcatgatggtgcacacctgtagtctcagctacttgtaggctgagatgggaggatcacttgagccaaggagggtgagggtacagtgagctgtaattgtcccactgtgcttcagtctaggcaacaggacaaaaccctgtctcgaaacagacaaaaagtccaatcgacctggggttagattctggtcctgaatctcaggtgatttttgtgaaatcaagacattttatgtaaagggtttgtcatgtttggcatttaataactaagcaatgataagcactacttaatatcaataataatacattttcctacgtttgatagagtgcctggtaataataaataatgatacattttcttatgtttgctacttagtaaataataggtagtaatctagtcattatataataaatatatgttttatgtatttttaatagttccatataagccaatgacgtttggctgggtgttgcagaattaggcaccatttttataggtgtcaaaataaagtcttaaaaaattatccctgtatttgcagatgagtgtgaagagtcacgaacattttaagttatacaaaacgtaatcttctaaaagtggactgagtcccctgaagatgaagtgtgagcttcctggtaccttgctgtttgagagaagttgtaacacctaacataggtagtctacttggggttatgaactgtctatcgatggttctatttataactctgcactagtctgtttcccagtttctcagttcctttaaaaagcagtcagttcctttaaggaataaaaaagaagaactattctgtaagcatttctattttttaagctggtcttctttctcacttctccacggttgagtcaaacctggaggtttcctctctttttatttgttttgtgtgtcttttgctacctttctcagcctctccctgtcatggatactacagcccttctgcctttgcgttcagctctcactgggcctgagccaatgctaaggatatcttcaccagctggaggaatcagagtttagggctgggacatgtcagtatctgatgacccagaaattcctcatccataagtagcttgacagtcttctccctaactttcactgaaccaaccaatttccatgctagaaagagatgtcagacttggcccttgggactctctcttggtgaaattgatcttgctcttgtattttggccctctgttgccttcaactatctaagtatagcactcagctgctgacttaattgtgaattttgcaccaattgctagctcctgctgctttgctttgtggaaataaacaaagaccaacaacatgagaagaaatgaaggttgcatcttcagagattaccatagcaaggggttcagccacatcatccatctatgtttccattcatccatccatttttccatctattcatccattcatgcatacattatatatccatctatcaatccacccatccatccatccatccatcaatccatctgccatccatcctattcattcattcatccattatatattcatccactcacccattatatttccatccatccatccatctattcatccattggtccacctgttatataccatctatccatccatttatacattatctatttatctatccatccattgatttattcatcatccatttatacattatctattcatctgtccatcatccatccatcagtccacccaccatcaatttacccctccctccatccatcacccatccacccaccacccatacatcaatctatccatccacccacccatccacccatccatccatttatccatcatccacccattcttccatcatatatttatcaattcatccatcaatcatccatctatcaattcatccatctatctatccattcatctacccattcattattcacccatcaatcaatctttctatcactcatccatctattatatctcatttttccatccatctattcatccatccatcatcaatccattttctattcatccatccatacattaatttacacaccatctattcattcatcatccatccattcattcatcattttatgttcatccaatcatccattatctatgcatccatccatccatccatctatctatcaatctatccatgattcatttatctatccattcaatatgtattcatccatctacccactattcatatactaaaaagcatttggcagagactcacaggcaggcagagaagcaggacagcttcatagtggagaaaaagggaggcttcaggtgtgccctgactggaggtggctggcacagggagctgtaggaggctcactacaggcaggacattccatgttattggttacaagtgcatgtgtggcagtctcttgttggtcctaatttagaagtaggacaaaaattaggaacgctgtcagttattaaacaagtcgtggtcatttggggccaatgattacaggggtcattgtttggcttcctggactgttactagagacagtggtctgatttactacaagcatgatttgcagctagtaggctggcttttgggactggttactataggcagtggattgatttctaggctggttgctgtagatcttgggtcaggattctctatttatacatggcttagccattgtctgtattttcagtctctcagctccatgcagcagactgtgttccgacataccaaaatcagacctggtgtggcttcagagctgggcaagcctctttggccagtgacctcaccccagaattgcaagtccccctgaacccagatctgcccatttctactttttgtttctctttcctgcatgcttacccttgcaatttctgcaaaatctgggtccaattcatatcatttagcagggtttggcaaacttactctgtaagggcctaaatgctaagtattcttggctttgcagaccacgtggtctctgtagcaacaggtcaactctgtcgaggaagtggaaaacagacatagacaatacttaaatgaacaggagcacctgtgttcccataaaactttatttataaaaaacagaccactgccttatgtatctttagtacatagtgttgaatagagttagagccagtttagatctcagagttgatgttgtagcatacaatatggcaaaggaaagcacttaaatcggcttacaagtagctataactccatgttagctaacgagtttgttcagtatgtctgtttcctgctgtcatcatttgtgttttatcttgtctcttataattcagtggctattacaggaggccctatgtgtctttctcatgggctcagagagaaaataaagacaaaaatcaacttctctgtagagatgatgtctcttctgttacttgaatacaacaattgaattgaaaagaattcaacaaatacaagttacatatgagaaaatattttcattaaggagtgggtctcaaatttttagtctcaggacccctttatatccttaaaaattatgaagaaccccatttttcaggagccgtctgactgttttccacagcggctgcacaatcttacattctcaccaacactctaggagggttccaatttctccacttgctcaccagcacttgttattatccgaccttgatgctagctgtcctagtgggtatgaagtcaatctgatggtgggtttttaagaaaaattttagatttaaggggtacatgtacaggtttgttacatggatatattgcatggtgctgaggtttgggcttctgttgagcctgtcacccacatagtactcaatggttagtttttcaacccttgctccccctctctcccccttgtaggagtccccagggtctacttttcccatctttatgtctgtgagtacacaatgtttagctcccacttgtaagtaagaacatgcgttgattttctgttcctgtgttagttcacttagaataatggcctccagctccatccatgttgctgcaaagggcatgatttcattcttttttatggctgtgtagtattccatggtgtatatgtaccacattttctttatccactattgatgggcacctgggttgattccatgtctttgctactgtaactagtactgctagaaacatatgagtgcaggtgtctttttggtaaaatgattacttttcctttagatagatacccagtcatgcaattgctggatcaagaggtagttctagtttgacttctttgggaaatctccaaactgctttctgcaagggctgaactagtttacattcccaccagtggtgtgtaagcattctgatggtgtcttgaatttgcatatctttgatggccagtgatattgactatcttttcatgtgtttattggtcactcgtgtatcttttttggagggatgtacaattcaaatcctttacgcacttatgtttttattttatatttttatttttttctgagagagtctttctctgttgcccaggctggaatgcagtggcacgatctcagctcactgcaacctccttctcccaggctcaagcaattctcattcctcagcctcccaagtagctgggattacaggtgcacgccaccatgctcagctaaatttttgtatttttagtagagatggggtttcaccatgttggataagctggtcctgaactcctgacctcaagtggttcacccacctcaaccttccaacatgttgggattacaggagtgagccactgcgcctggccctacccacttgttttttttttttttttttgagagggagtctcactttatcacccaggctggagtgcagtggcgttatgttggctcactgcaacctctgcctctcagattcaagcaattctcctgcctcagcctccctagtagctgagactacagtcacgagccactacacccggctaatttttgcattttttgtggagacagggtttcatcatgttggccaggctggtctcaaactcctgacctcaggtgatctgcccacctgggcctcccaaagtgctgggattacaggtgtgagccaccatgcccagcccctacccactcgtaaattgaattttaaaagtaattttatcgttgagtgaaaaggatgatttctatattatggacacaagtctctaatcaggtacatgatttgcaaacattttctccctgccgtggttgtaatttcctttcttgatggtgccctttgaagcataaaggtttaagttttgatgaagcaggcctcaactctataactgaatttttttttcaactatgataaatgacatgagagcattaaagacaactttgcaacaaatgtttttctttgactgaacttgcttgaacctgccccagactgaaagttgtgagaagatataaaaagcaagcaatgttttctacattttccttgttttaaaatgttggtatcacatgaactattaatttcttaggcgtggtctcccagttgactgtcaattatgaatctcagagagttttatctttgacaccatcttggtgggtcatgaatttggtttaatagtgccagagagaattaagaggctttaaaagggaccataaatcatcagtaaaaacagtcagccccttaaaaactctgtaatatacttttagaaagtagacgctttcccccaaccaaacaatggccgagtattttggaatgtggttaggcaggaaggagcttatgccattcacaaaacgaaaacactttctgccaaattcttcaaaatgtcaggagtagtatgctggctttgggtttgaaaaatgggaatttggcttgaaaaatatacatttatattgtagctaaaaacctgcatttggctgacgatgtgtagagatgaagattggtttgggatgtctactcattttaaacaaatactgcttattattcttattgttattttaaaattttatcattattattattttattatagagatggggtttcgccatgtcacccagagtggtctcaaactcttgggctcaagccatcctcccacctcagcctcccagagtgctgggattacaggcgtgagccaccgtgcctggctgttatcattttaaaaaatatgttattggccaggcacggtggctcatgcctgtaatcccagcactctgggaggccgaggtgggcagataacttgaagtcagaagctcgagatcagcctggccaacatggtgaaaccccatttctactaaaaatacaaaaattagccagacatggtggcgtgcacctgtaagtccagctactcgggaggctgaggtgggagaatcgcttgaacccgggaggtagaggttgtagtgagcagagatcacaccactgcactccagcctgggcgacagagtgagactccatttaaaaaaaaaaaaaaagttatcatgcttagaaaaatatataaaaattggatcttttcttaaaatataggaaaaaccagtcagtatgcatttatgaaatttaaggacatttttgctaagcacgttttcttttaaagttcataaagactttaatgtaaaaaacaaagtggatggtatctagaaatatcagcatttgcagaaccacaaataacatatttgccaagagatatcccctctaaggatgtcaatttatttttaacattggcctcaaacttccagcatctgatatgttaatttctgtgtcatggccataagcaggaaaatgataatttgtaggcaaaagtagaaaatctcaagcagatgggaatgtgttcaaatatgtaacctatccagaaggatcactccatcagcaggatgaattccagcctggctcttgcaggagacccccgaatcccagagctgaaatatgcagtcaccaattagggtcacatgtgctcttattcttatttgtattatttttgagacagggtctcattctgtctcccaggctggagtgcagtggagcaaatgatggctcactgcagcatcaacctcctagggtcaagtgatcctccttattcagcctcctgagtagctggaactacaggcctagctaatttttttttgtttgtttttattttttattttttgtacaaattttatttgtatttattttttttttagacagagtctcaccctgtcgcccaggctggagtgcaatggtgcagtctcggctcactgcaacctctgcctcccaggttcaagcgattctcctgcctcagcctcccaagtagctgggattacaggcacctgccatcacgcccaactaattttttgtatttttagtagagacaaggtttcactatgttgaccaggctgatctcgaactcctgacctcgtgatctgcccacctcagtctcccaaatgctgggattacaggcgtgagccactgtgcatggcccacctagctaatttttgtagagacggggtctccctatgttgcccaggctaattttgaactactgggctcaaccgatcctcctgtctcagctttccaaatttctgggattacaggcataagccaccacacccagcctattattattatcatcatcatcatcatcatcattggtttcactaaaaatataatgactccttgcactttttctttctttctttctttctttctttttttttgatggagtctttctctgttgtccaggctggagtgcagtggcctgatcttggctcactggaaactccacctcccaggttcaagcaattctcctgtctcaatctcccgagtagctgggattacaggcacgtgccaccatgcctggctaatttttgtatttttagtagagacagggttttgccatgttcaagaggccaggctggtctcttgaactcctgatcttaagtgatccgcctgcctcggcctcccaaattgctgggattacaggtgtgagccactgcgcccggccatccctgcattttttcaatcatctttttttatttgttctgtaatgcttgtaatgaaaggagttgtgcagagcacatgcaggcgcaaggtgggtggttttccttttgtctattttatttagttaacttttttaactttatttttcatttttttttaaattttgtttcaacagtttttggggacaggtagttttttggttatgcggataagttctttagtggtattaataatttctgagattttcatgcacctgtcacctgagcagtatacactatacccaatatgtagtgttttatccctcgcccccttcccccgttccccccaagtccccaaagttcattatatcactcttatgcctgtgcgtcctcatggcttagctcccagttgtaagtgagaacatactcacttaatatcatggatatttgcctttcatccccaacttacttcgcttagaataatggcctccaagtccatccaagttgctgcaaaggccatatattctattttttaaatgaatagcctttgcttttggggcagtttcaggtttattaaaaaactgagcagaaagtctagggttcccctagacccacttgcctgtatatacaacaaagtttgccccatgattgacaccttgcattagtgtggtacatgtgttacaattgatgagctgatagtgggacattatcattcaccagagtccacagtctccatgagggctcactctttgtgctgtgcagttctatgggttttgataaatagagactgacttgtagatatggaatagtatctgcagatacatcgtacagaatagtttcactgccctcaaaatcccctatgcttcctgtgttcctcctcctctctctcccccaggacactgacaaacactgatctttttactttttctacagttttgccttttgtctgtttttaatttttagtctacataaaaatgtgactgggttgaaaagcatcatcggagagttgcattgaattattcggttccataatggtaaatcaatggtatcactatgcaacgaggaacggaaagtagacagtctttgccatggctcatcttcattcattttgttacaggaaaggtgtcctgatccagacctcaagagaggattcttggattctgtgcaagaaagagttcagggccagtccacagtgcaaagcaaaagcgagtttattaacagtgtaaaggaataaaagaatggctactccatagacagaacagccccgagggctgctggctccacatttttatgattatttcttgatgatatgctaaacaaggggtggattgttcgtgcctcccctttttagaccatatagggtagctttctgatgttgccatgacattcgtaactgtcatagtgctggtgggagtgtagcagtgaggaccaccagaggtcacactcatcaccagcttggttttggtgggatttggccagcttctttattgcaacctgtttttatcagcaaggtccttatgacctgtctcttgtgctgacctcctgtctcatccttagatttagaatgcctcaactgtctgggaatgaagcccagtaggtctcagcctcattttatgcagctcctattcaagatgaagttgctcttgttcaaaagcctctgacaatttcggtgcctttgttgggaagggacactgctttctgactgagccagcccttgggttctttgcccattgttgactcttttgccagtgggccagatggagatccttggctcctccccaagcccggctgttttggggtctgttatcccgtctgccacttaacaacagcatactgaatttacaaatgactcaaggagacagggtaaatatggtgaagcaaagtgttaatggctttatgcttaatatgtatctcttcctatcaaaattttgggatttcaaatgtaatttctttcttttttaaaaatatgtattcacctaatatagaatgattttaaagaatatgatttagtagcatgttgtacattcacaatgttgggcaacaatcacctctatctagttccaaaacatttttatcaccataaaaggagtcctcataccattaattagtcccacccctttcccccttccctcagcccctggcaataattcatctgccttctgtctctatgggtgaacctatagaatgcaattgtttttggtagccattatccatctatgagttagaagatgattcccacttccctatctggtccttagtgtgcagacgacaaaaatcaaggtaactcacctggcaagtatttgtattagcaaacagcttacagggacagagtttcaaaaataacaaaatcgtaagcatgcatattggaatcaacatagaatatctgtagaaggagcagtaatgaaaatttggataaagcagaagtatgtttgactaaaatacattgttctattctccttttttttttttttgagacagagttttgctcttgttgcccaggctggagtgcaatggtgcgatctcggctcacagcaacctccgcctcctgagttcaagcgattctcctgcctcaacctcccaaatagctaggattacaggtgcccaccaccacgaccggctaatttttatatttttagtagagacggggtttc[132 bp omitted]caaggcaattatctctaaaggggattcagttgggagctgcatgagtatctcatgcagctatgtgagatgtgaaaagacatctcacctgcaacagggaaaatgccaaccttccctatcctattacctattgtatgatcctgtccccaacctctaacactcagcgatagctcaaaggattggggctggacccctgactcaaggcaagcctcccttgactggacagtgactcatgacatgtgcagacctgctggaaattgcaagatcatacaggccctttgtacaacataaacaaataagactgataatcaataatttttagatttcggattcaatttatagaagtccccccctccaactccctaaacccaccttgtcaccgtggtgatcttcatcagtactaaacaaggataagctttgttttttttagagacagggtctcactctgtcacccaggctggagtgcagtggcacgagcatagctcactgtagcctccacctcctgggctcaagcgatcctcctgcctcagcctcttgagtagctgggactacaggcatacaccaccacgcacaggtaatttttttaaaaaattgtagagatgggttctcaccacgttgcctaggctggtcttgaactcctgggcttaagcaatcctcctgccttctcatttctctgtgcccgggctgagtgtgggagtagaagattttgtttgcagaaaggtcacatggactcattctgattctaaaattaaatgaaaagaaaagaaaagtagcaaataaaaacagaaaacaaaacgatcacatggatgtaccattttgccccaatgcatgttgcctaagagagacgatgccttcccagttcgccagagctatggctcttagtaggtgtctaggtccatttcgtgttgctgtgaaggaatacctgaggctgggtaatttataaagaaaagtggtttatttggctcatggttctgcaggctgcacaaatgcatggcaccagcatctgcttctggggtgggcttcgggaagcttccactcatggtggaaaaggaaaggcagctggcgtgtgtagagatcacacagtgagaaaagaagcaagagagaaaggagaggacgtactaggctgtttttaacaacaagatcatctgggaacaaatagaccagagaactcacccattaccaaaaagtcatcatcaagccactcatgaatgatctgccccatgacccaaacacctttcaccaggcccactaccgacactgagggtcacatttcaacatgagatctgaaggggagaaatatccaaactacgtcagtaggtaaaggacacgagaagagtggtgctctatcagaatcactcagggagcatttatgaaatatgcctgctttaccctttctccttcatcatgctcaggggatattcacaatacatataaaaaattaatcttcctcttgaggactttccttctttgcaatctttccctggagctgaggatagccagactctaaatggataacaaataatttctcttgacatgtgctttcctttgcaacgacgtatgggaaattgaatttctcccaggaagaagtggggatggatgaaaccaggcttcaactcaatgcatctgtgtaattgctaagagagagctgcttccaccattaggtattataagtaagtaatgatttcggtctccttgctgtggaacagacaaatggcatggtatttgcacaaagcagaaagtgtaatgttagtactgattgtaagtaaaattaaaatttgaaaaaaatctatccattgtacttggatttttcgccaaaattatttatccttcttctccatatcctttaatcttttttcttgcttaatcctccatattcctttaatctaattttcctgcttgtaagaagtcaaaggtggggcacgggaagagaaagaactctatttttccaataaagactgggtgtctattaagagtagattcacccacatatcaaagaaaatccaacaagcttcaacaaggcagaggtttattttggagaagttttgaaaagggcagggcagggtctatgtgacagttacatggttttcagggaccaggatctttttgtctttctcctccactcgtctgtctctgagctacatttctatcagttcatgtttcaagatggcgccttgagccctagacatcatgtccaagatgcaagagagggaggacacaaaaagtactccatctattttttttttttttttttttttttttttttttttttgagatggagtcttgctctgtcgcccaggctggagtgcagtggtgcgatctcggctcactgtaagctccacctccccggttcacgccattctcctgcctc[222 bp omitted]ttttagcttcagggggtacatgcaccagtttgttccatgggtatattgtgtgatgctgacgtttgtttggggtacagatgatcccatcacccagatactgagcatagtacccgatagttagtttttcaactcttctcccctctctcctaccccccagtagtccccagtgtctgttgtccccatctttatgtccatgagtacccaatgtttagctcccacttataaatgagaacatatgttaatttgcctaggataatggcctccagatgcatccatgttgctgcaaaaacatgattttattttttatggtggcgaggtattccatggtgtgtaagtgccatattttctttttttcttttcttttctttctttttctttcttttttttttttttttaaacagagtctcgctctgtcgccaggctggagtgagcgcaatctcgggtcactgcaacctccacctcccgggttcaagcaattctcctgcctcagcctcccaagagctggaattataggcgcatgccaccacgcccggctaattttttgtatctttagtagagatggggtttcaccttgttggccaggctggtctcgaactcctgacctcgtgatccacctgcctcggcctcccaaagtgctcggatgacaggtgtgagccactgcacctggccataggtaccacattttctttatccaatccaccactgacaggcatctaggttgattccatgtctttgctaatgtgaatagtgctgcaatgaacatgtgagtgcatgtatctttttggtagaaggacttattttctttggttatatatccagtaatagaattgctaggttgaatggtagttctgttttaaggtttttgagaaatctccaaatgcactccatttttcatagctttcatggaggcttcacccaagagactccattagaaatcccatagttggccaggcgcggtggctcacgcatgtaatcccagcactgtgggaggccaaggtgagcggatcacctgaggttgggagttcgagaacagcctggccaacatggagaaaccccatctctactaaaaatacaaaaaattagccgggcgtggtggcatgcgcctataattccggctcttgggaggctgaggcaggagaattgcttgaacccgggaggcggaggttgcagtgagccgagatcacgccattgcactccagcctgggtgacagaacgagactccgtctcaaaaaaaaaaaaaaaaaaaaaaagaaatcctgtagcgatgggggaagctgggattgtagcctttaaactgatgaccacctaaaacgatgaaactcctgataatatggacaatgggaagaggagacattagctaagcagttaggagtctaccacagagtggaagaaggaagaggtgaagctcacagtgggaggaagagagatgggttaattagattagtagtaggaaggggtgtaggaagaggaaagagacatgtattggggttttcccacgtcactttgtaagaccctgaaatccacaccacactggacacccttaacctgaagacgtcctgaaacttggcctttctctgtggaattatgatgatggaattctctcctctgaccttcttcagcctatactgagagagttccttgagggatacaaagggaatccaatctaatccaactgaaaaaaaaaaaggactttcatctttcttcaggaagaaaaaatgttcaaactgcaaccacagagacgttatcatctgttctccgatggctacttgggatgcaattgtcttgatgaaacttacagagcttattcagttctggttcaattcacatcccagtgtcaatgggattatacttaaagttatgaagggagctggtgtttctgtcaatgtgggactcttatttcctgcttgtatgttgagtgcctcaactctagatagttgcctgaggtttgttttctttctgttctcaaagaaagatctggggcagagatactagggcttctctctggagaaagtcctgtagactgcagggatctgctttttaacttataggcaattgacaggcaggaaggctgaccagacaggaaggctggtgtcagtggatctgccatgagtttagagaaggaaattaataaggaggcccaaggctcttttatctctgcccataggtttttgttttgttttgttttgttttgttttgtttttgtttttgttttgaggcagagtctcactctgtcacccaggctggagtgcagtggggtgactggggtgatcttgactcactgccacctccactttctgatttcaagtgattctcctgcctcagcttcccaggtagctgggagtacaggcgtgtgccaccacacccagctaatttttgtatttttatttatttatttatgtatttatattttttgaggcagagtatcgctctatcgcccaggctggagtgcaatggcataacatcggctcactgcaacctctgcctccaggattcaagcaattctcctgcctcagcctcccgagtagctgggattacaggcgcctgccatcacacccggctaatttttgtatttttgtagagacaggatttcaccatgttgggcaggctggtctcgaactcttgacctcaggtaccacccgcctcggcctcccaaagtgctgagattccaggcgtgagccactgtgcccggccagtctcacacttcttaaaagaaaacataaagtgaacaaaaaaatatgaaaaaaagctcaccatcactagttatcagagaaatgcaaattaacaccaaaatgaaatagaatgactattattaaaaagtcagaaaataacagatgctggcaaggttgcagagaaaacaaactcttatactctgctggcgggaatgtaagttagtatcacctctatggaaaacagtatggagatttctcaaaaaactaaaaatagaactaccatttgactcagcaatcccactattgggtatccactcaaagggaaagaaatcattatattgaaaagacacacacactcgtgtgtttatcacagcaccattcacaatagcaaagtcatggaaccaacataataagtgttgattggattttaatccaattttaatccaatggtagattggattaaaaaaatgtggtgcatatacaccatggaatactatgcagccacaaaaaataacgacatcatgttttttgcagcaacatgaatgtagctggtggccattatcctaaatgaattaacacagaaaaagaaaatcaaataccacatgttctcccttataagtgagagctaaacactgaatacacatgggcataaagatggaaacaatgggcactaggttcagtatttgagtggtggattcaatagaagcccaaagccaggcattacacgacatacccttgtaacaaaactgcacgtgcaccttctaaatctaaaatgaaagcaaaataaaatgatctcaaggttcttgccttcaatgcaaacaccctgtgtactcttctccccttgagtgtgggtaggactgtgaaatagcatgaatgtcactcctgtatttaagtttcattatatg[137 bp omitted]catggcgaaaccccgtctctactaaaaatacaaaaacattagccaggagtggtggtgggtgcctgtagtcccagctactcaggaggctgaggcaggagaatcacttgaacctgggaggtgggttgcagtgagctgagatcgcacctgggctacaagagcaaaactccatctgaaaaaaaaaagaaacctcaaacaaaaaacaaaagaaaaataaaaacaaagtaactgaggtctctcattaggtgactttatgttaattaaaaggagattattctgggtaggcctgatttaatcaggtgaatcctttaaaagtacatctgtaggccaaagacaggagaagccagatagattttaaacaacaaaaatattttccttttggccttgaagaagcaaattaccacatgatgaagacagccatatggcaggaaatggactgatggcttcattcctataaccacaaataattgaatcctgatagtagccagagagctcaggagaggatcccaaaactcagataagatggcagctctgttgatttcagccttgtgggatcctaagctgaatacctagccatactgtgcctggaaatggtgtgagattgtgaatgtatgttgtgttaagtcacaaagactgtgatcatttgttatgaagctatagctaactaatacactgctcatttctgatgtgaaatgagcagggagtccttccttagaaggctgtccatgggtggaaaaagcctggccatgagtcatatgctccagctatcaaatgccaaacacctttgtgtggaggagatactttgttagtatttactatctactgtgataattcaagaaattggaatctcacttagaagaaagatgaaatatttcatatcaaaatgcctcgctgaatactcccacatggctccttggaaaagtttctgaaaggctcacccactctcgaatggccactttatttacaggggaaacttagttgctattgactaaatgtgtccctccaaaatgcataggttgaatcttaactcccaaggtgatggtattaggaggtggcttttaggaggtgattaggtcatgagggcggagtctcactaataggattagcatccttctaaaagagaccacagagagctcctttacctctttccaccatttgaaaacatggcaagaagtcaccatctatgaaccaggaaggaggtccccaccagacacagattctgctacaccttgatcttggagtttcagcctccagaactgccagcaataaatgtctgtggtttaaaccatccagactatgctagtttgttatagcagcctgaatggattaagacaggagtattctaggataccaaaatgcaaggaatcaccatccattctgtgcctcccatgtacctccctagaggcatttatagtcttaggagggctgggctggattatgggttcccacagcccagtttctgctaactgcataattttattcatgaagttgctaagcagtgtcctgcccctttcttgcatctggtttactggcaacaacaaaccgtgaattactgtttactctgctccaaatgaatagttctgacccaggcaatgtgtgaaactggtagaaagcaagttctcctgacaggaatcactttccattcacaccaggaggcatagaataaaaccaatcacacagttacactttcagtttcttcctataatcacaaagaactgaatcctgacaatatccagagagctcagcataggaccccaaaactcagataagactgcagctctgttgatttcagccttgtgggaccctgagcagaagacccagctctactaattctctcttctaattttataatgaatcattcaactttccaagttactgtgatcaagcaaaaatgcatgcctgatgttagtatttttccctacaggtgatgtgtctcaaaggagcccaggacaagtagcaaggaggtgctttgtaaggaaataggaggaaacccaagctgttattgtcctgagaattcttacacgtattgagtttgccttttggccactctttctgaggcgtatgtagaaatttgccggtaacctgactcttagctcggatccactttgcccacacggaggtaccacgcattgcaggtggctttgttttattcctttgtctccagcaaaactggccatctattaacttggctgttctggtgcatttgttcaaacaactcctctttatctccctctgcagggttcccttagcaacatgctttctgacatcattaccaatcttattttgggaactgggctgtacggaagatccctagacaccctaccgatgtgtggcagaactttctgggagttatcatgtaactaatgagcttaagaattcattccaaccaaaggcaatgctagtttgtttcccagtttaaacctctaatcatggagccctagagagttaggtatacgtgggttatcaccatcatggcgcccatgtgattaaggagttttgttttttgtttaacagatttggggctgctctgtccagacctgcccattgtaaagctactggggccacatgaggctgtttcttgaggatgcacagaatcttgtgtgttcaccacccttttttatgtatacacaaggagattccacttataaatcctgtgtacttgtatttatttcaggtcatattccttccaggacttggagaggggagatgtgttaaatgaagaattgtcatcactaatatgctttgagttgattgaccttcatgtcatagaataaatgttcaactttgcatcacgtcaatgtttgcctccttcccacctggagagaacctagtaagaaagaacttgagtagcaatagtaaacaataaatattgggtcatcacataacccatgttagtctcacccagatgcaaaacatagctaaaaacagtagaaaatggcaacaaacagtcttagaaaaatacagaccctctagtgactgtttttgtttgatggctgacattggtctaaagaaatttcaagagagctgaagggtggcatcctgttttatttcttcaatccttggaagagctcccttgcattgagaatgcacacatttgcatttcaaagcaagtggggtttgggtaaacagtcttagaagtcaaagcaaccatctcctagaagcaagctgtatatcaggtagagaaagaagagatgaaaaagggccatgactatgcccatttcagtcatctgcttgggatcctgccacatggcagagtttggtggacacagcacttctctgctccctgggacataagcagaaacatctttggcatgactgaagcattctactcccaagatggccccatgcattggcctggcagaggaatgctgtctgaaggccaggagctcagtatggctattgactggcctggcctcaattctcctccacagggatcgttcaggcttcttacaatatggctgtctcaaggtagttagagggtgacttaccccatgtcacaaaagcagaagctttcagttcttcttagacctggggtgagtgcagccaccctctgccatatagtgttggataaagcatatcccagggctactctggttcaacagaaaggtatacacaagggtgtaaatgccagaggtcaaggttttttgggggttacccaagtggagtcaaccttcattatttgcagatgctctctttgcaaattcagctacttgctctaatttctttgtaaccccaaattaatactcattgcactttcgtgaacatttaaagcaataaataatttgagtcacctggtttgtacatttctggctaagcttgaacaaggcaatgctctgccttcttatttcagttcatactataaacaagtgccttgttgtggtctatggagtgccatgcttttttcatttttgcaaaatgcagcctctttctgctggtaattttgctgtttaaaatgaccctaagcattgtgctggagggctgtcaagtgttcctaagtgcaagaaggctgtgatgttgcttacagagaaaatatgtgtgttagagatacttctttcaggtgttcaggcaggagttacagttgttggccgtgagttcaatgagaatgagtcaacaatatgtattcaataatgtgcctttaaacagaaacacacctaaaacaaggttgtgtattgataatttgatgaaaatgtgaccagacactcgcaggaacctaaccttataattctagtaggatcaatggttcagtctttgctaattcagtgtttttggcgattttataaaatgactgctgtgaataatgagaattggctatatcagttcatcataaacaaccaatgagctttcgatttgacccagatctgattcaagtgatcggaagactgaatgtatgctgtgaatgcaggagtctataggatcaatttccactggtcacctctggcaatagtccaaaggggctgatccactcactgcctctctagttgaacaaatcttagaatatagtgatttggcattttcctcttctctgattcgaatgggtgggaatggacctgtcatccatttcattaagtgtttttaattttttattttaagataatttttaagacacacaaattattgcaaaaatgatacatagagttcctgtggacacttcacttagctttccccaattataacatcttatttaactattgtacaccatcaaaaccagtcaactgacattggtacaatattgtattattctgttttcttctgctgataaagacgtacctgagcctgggtaatttataaagcaaaagaggttaatggactcacagttctacatgactggggcagcctcacaatcatggtggaagatgaaaggcatgttttacatggcagcaggcaaaagagaatgagagccaagcaaaagggtaaatcccttataaaaccatcaggtctcattagacttattcacttccacaagaacagtatggggaaactgctcccataattcagtgatctctcactgggtcactcccacaacacatgggaattatgggagctacaattcaaaattcaagatgagatttgggtgggaacacagcaaaaccatatcaaatactcttcactaaattacattatttccatgggttttatgtgaaatgtgtgtgcatgtgtagtgctgtgaaattttatcccctgtatagattcctatcactatgactatagccaagcatgcacctctgcacgtgcctggctacagtgatgattgtaggaataggaaaagccaatttgtgaaagaatatctcaaagggaaaatgtaatgtttcctaatgtacaagttgttgtctccagagcagttacagggcactataacctaacatctgtgtgcttctaggacaagaggcatcagacaaccatgaggttgcagggcagagagtaggctgaactcaggatgaatgctgcatgggctgcaagcttgctttattttcatttctctcctctcttcctctattattaattcatgaaaattatagggactgtttcagagctggtaatgaaagtatctgcattgagctgtcaagactctaaaccccagtctcaatagactgcacaagtggctggttgtgggctttagtctctggattcttcctactgctgctttaagagagaaaagccactcatagcttcctggagagcctcgttccccctcatcatggtccctggggacactgactatagactccaatgggtagaaacagcatctgttttggacacttctgcaacctactgtgcagtagggctcctggtcttcgagtagtgttccagtcacgcctactggctttttagtactctgctgctcctccctttgtgctatcaggacatttatggaaactccaatgcaactacagcatcaggcatcctttttccacccacacactatttctttcccctgagtccaggaatggggaaagcaaaaaccagagaggtctcggagcaagaccaaagtactacctttccagaagcaaggggccacagaggcctggatattagttggtactgttactggaaaggggtccttatccacaccctaagacaggattcttgaacctcatgcaagaaagaattcagggcaagttcataaagtgaaagcaagtttattaagaaagtaaaggaataaaagaatggctactccataggtagagcagcagtgtgggctgctctgctgattatacttatagatacttctggattgatatcgtttggctctgtgtctccacccaaatctcatcttgagttgtaatttccataatccctgtgcattgagggagggacctggtgtgaggtgtttggatcatgggggaagtctcccccatgctgttgtcatgatagtgagcgaagtctcaagagatttgatacttttataaggcagttttccctgctttctcttgcacctgctctcttgcctgccaccatgtaagacatgcctgcctccttttaagccatgattataagtttcctgaggcctccccagccttgaggaactgtgagtcaattaaacctatttcctttataaattgcccagtcttgggaagtttttcatagcaatgtgagaatagtctaatacattgattatatgctaaacaaggggtggattattcatgagttttttgggaaaggggtgggcagctcacagaactaagggcttctcctttttttagaccacatagggtaacttcctgatattgccgtggcatttgtaaactgtcatagcactggtgggagtgtcttatagcatgccaattcattataattagcatataatgagcagtgaggacgaccagaggtcaccttcatcaccatcttggtttttctaggttttggacagcttcttactgcatcctgttttatcatctgggtccttgtgacctgtatcctgtgttgacctctcatctcatcctgtaacttagaatgcttaacttcctagaaatgcagcccagtaggtctcagcctcattttgcgcagcctctattcaagatggagtcactctggttcaaatgcctctgacagtattttcataaaggggaggtcattcctggatctttctatgcgaagaggaccagaaagatccttcataatttattacataatacctttgggtgtgtgtattagtccattttcatactgctgtgaagaaaatacctagactgggtaatttataaagaaaaagaggtttaatggactcacagttctgcgtggctgggaaggcctcacagtcatggcagaaggtgaaggaggagcaaaggcatgtcttacatagtggcaggcaagagagtgtgtgcaggggaacagccctttataaaaactatcatggttttataacaaggggatggcacattttcacttttttttttcttttcttttctttttttttgagacagggtctgtctgtcacccaggctagagtgcagtggtgccatgtctgctcaccgtaaccttcacctcctagactcaaacaatcctcccgcctcagtctctggaatggctgggactacaggcacatgccactacacccgacatatttttagtatttttggtagagaagggattttgccatgttgcccaggctagtcttcaactcctgggctcaagcaatccgctcgccttggcctcccaaagtgctaggattacaggcactgtaatccagtgccactggacccagctttctattttttgattgtgttaaaatacacatagcagttgcatagtgtcctcatctgttcatttcctcctccgccaagccctggcagcattgttcgattttctgctttgatgattttgactattccaagtattttcatgaaagagaagtacttttatctgaggaatttgagcactttcaaattattaggcccagaaatgtattaagacgagacagcaatcgtgtcctagtccccgctttgagctatgtatacatctattgaaactgcttgccattgtcacacataactataagttaacctaataataccacactggataccacaacccacaccctatggcttaacgagagacagccaatcacgaatcagtattatttctgtaaacagcaagaatttctgacaaacaattttgtatccactccccgtgaaatcgcttctctataaaaagtgtaaaaattagctgggcgtggtagcgtgcacctgtagtcccagctacttggggggctgaggcaggaggatcacatgagcctaggaggtcaaggctggagtgagccgtgttcatgccactgcactccagccggggcgacaaagtgagaccctgtctcaaacacatccacttgcaacggctgctaatcagagcgtctaagtgtatattcagggcaacttgaatctattcttccagtttgcaagcctcaagcttggctcaaataaactctctatttatattaattttgcctcagcttcttccttttaagttgacggcctcaaataagcagaaccacactctagttgtccttttgtgcctggcttatttcacttagcgtaacagcctcaagattcatctgcattatagcctgtgttagaatttccctccctttgaaggctgtatgattcaatcaataacaatttgaaacaaaagctttcaggcagggcttaatcttccaagaagaagacaattttaaatacatgggcaatttgaaagacactctaaaactagcaaggaagcactttatggtaaccgcaattgccaattaacttgatgttgaaatcacatagacaaagaaaaaggtgagtgaagagagggctagaatggctttgttcctcttaattgtcttattgtacactggaaaagttgcttggtttgcaaagacaggtgtttggaggaatctacagcgcttagaattacccccgggtgagctagctgtttcacgggaggatcttttgactcagcttggccatttttcaaatgtggaaaataatcagctctcagaaaggcagtttagagcagtgagtgctatggtttggctgttcgggaaaccagggtcctcttctgtctgcctcctgggtttctgatgtttccttggagtatcttcctgcttccccaggatctaaggaacagaaacatcagtcacagctctcatttcactgcaaatgtttttctctgcatgcgtctctactggaatacttaaaacccggcagacaggttttttttagagggttatgttgttgaatacagaaagaattgaatgcatctagctcggagacctctcaaaaaaaaaaaaaaaaaaaaaaagaaagaaaaagaagagaaaagactgggtgtggggctttagggaggcaaccggctccgcagagctacctggggagttttcagaacaaagcagatgcaatgtcgatggaatccaatctccccgtccttgcccttgcaggtccccagggggaggaggctttgggaaaaggcagacctcacgactcctctttcaaattgtccctttgaagacctgccttagatctgtctacagaagcctcaccccaagcagaaggagagcctggattttaaaatttttgttgtttgctttttgcagacaggtgggtcctacctgaggctaccaacaatgagatccttcaggtgataggatatgggccaggtctcccaccctcagcaaggcaggtcactgcaaggcttgggaggtgccctaaggggatttaaacaaacttgggatcttgtgcctcctactgttacaggacaggggtcccgagactgtatagggtaacttcctgacgttgccatggcatctgtaaactgtcatggtgctggtgggagtgtagcagtgaggacgaccagaggtccctcttgtggccatcttggttttggtgggttttggccgccttctttactgcaacctgttttatcagcaaggtctttatcacctgtattttttgctgacttcctatctcatcctgtgacttagaatccctcaatcatctggaaatgcagcccagtaggtttttgcctcattttacccagctcctagttaagatggagttgttctggttcacacacctctgacactactgttagggtaggtagcgtgtcaggcatgaacagggcaggagatgggttccccctgctccctccccacacacaccagaaatgtcagaagaccatcaggtgatggtcaggcggttgataaactgtctctaaaataataattggtcacagtcagcaccagggaaaggccgtctcccagtaaatagaaaacacctaaaactggtggtcagcagcttcccaatatgatctcaggaggtgagtgagtgggctcaagcacgcacactaagaggcaaaatggcggagtttaactggtctacaaccttctaggaacacttcacttgtaagggaagaacacctcaagtgagcatgcgtacaacaccagtaaacacactgcgcatgctgccctcccgagtgctggcaggccactgtgcatgcagacagcccaccccaaaggaagactcagcggagaagggacacaagactccagtctaaaagtcaacgcataaaaccccaagtctaaaggtcaaaccatgcacttgactctgaagttgcccacttgaccctcttccaagtatactttcctttctttcgatcgtgttataaagctttctgataaactttcactcctgctctcaaacttgcctcaatctctccttctgccttatgcccttcagtcaaattctttctcctgaggaggcaggaattgaggttgctgcagcccggtatggcttcacccgcggtaacaccaccactccagtgcttcccaggtgcctgctctccgcaactctctggatggctgggaagcggggcacccaggaaagcaagcagttccaagaggaggaagggtccctgctgggcgggtgtacacaggtgggctcctggcgcccacctgctgcctgagtctcagcctcagaggagctcagaggatagatgagatgcacccactgctgggaactgggagaaacgcaatcccaaagacaggagcagtagacgggatcccatttccttcagggtttgacctggataccacaaagcgctccaaaaaatgtcacggcgaataaagggtgtccatagtaaactgctgatgaagccacaaggaaaccactgcccatcctgggccttcttcctggctccaggtcccagcaggatgtcagccaccagccatggagggatgggtgtagtatctctgagactgtgtggttttagttttctgtttcaattgttgcaagatgcatgtaacctacaatttaccattttagccactttgtgcaatttgatggcatttagtgcattcgcaacagtgaattcgtgtttggtgcacaacagtgttgtgccatgatcatgccaatcaacgatcaaacacttttttttttttttttttttttgagacagggtctcactctgtcacccaggctggagtgcagtggcaccatctcggctcactgcaacctccgcctcccaggttcaagtgattcttgtgcctcagcctcccaagtagctgggattacaggtgcccgccaccacattcggctaatttttgtatttttagtagagatggggtttcaccatgttgaccaggctggttttgaactcctggcctcaagtgatccgcccacctcagcctcccaaagtgctgggattaaaggcgtgagtcaccatgcctaatcaaacacttttattacttacaaagaaatttcacccaatagttatcagcccctcaccctgcaatcctctccccacctgaagcttccagcaaataccactctgctatctgtctctctgcctattctgggcctttcatataaatagaatcatacaatatgagacctttgtgtctgtctttttaaacttagcatcatgtttccaagttcattcatgttgcagcatgtgtgagagctccagtcttttttattgttcaatcatagtctgtcgtatgtgtgagctacatttatgtaactgcattcgtgctccagtgaatgtttaagttgtttctactttttggctcttgtgcacgaagctgctcttcatttatttatttgttcatttgttttgagacagggtcttgctctgtcacccaggctggagtgtagtggcatgatctcggctcactgcaatcgctgcctccctggctcaagcaattctttcatctcagcctcccgagtagctgtgactacaggcgtgcaccagcctcggctaatttttgtatattttgtacagactgggtttcaccatgttgaccaggctagtctcaaattcctaggctcaagtgatccgctcaccttggcctcccaaattgctgggattacaggcgtgagtcacactgcccgacccatggtgctgctatgaatatggtgtgtacatatctgttggagtctcaattattttttaaattcttttcatttttagcgatgggggtctcggtgtgttgatcggcaggctggtctcgagctcctggtctgaagtgaccctcccatcttggcctcccaaagtgttaggattacaggcgtgagccattatgcccagccccccgccccctttttttttttttttttttttttgagatggaatctcactctgtcgcccaggctggagtgcagtggcacggtctcacctcactataacctttgcctcccagattcaagcgattctcatgcctcagcctcctgagtaactgggattacaggtttagatttagtagagacaggatttcaccatgttggccaggctggtcttgaacactcttgacctcaggtgatctgcacgtctctgcctcccaaagtgctgggattacagatgtgagccactgtgtctggcctccgattcttttctgtatttacccaggagtggaattgctggtcatgcggttgagactgtttcatgttggctgtgcatcagctttcaacctccatcccatcctggaatagaggtactggtggtttcataattatatctgacctgtatcagacccacttttgtttttttggctgattggtactcttttttatatgtctttcgtcacattttcttgacacatatctgggaatgcttgactgtgtggggttggttgtgtggagtgctcaaagtgagaagaaagaaggaaggaaggaacggaagatgggagggaggaaagataaaaggaagcaagagaaaggaagaggggaaggagaaggaggagaagaggaagaggaagatgagggagaaggagatgaaggaggaggaggtaaaggaggaggaggaggagaaaaagaaaaaattggagggagaaggaggagaaagagaaggaacaataggaggagaaggaggaggaggaatagaaagaggaggagaaaaagaaagaaaagttggagggaggaggtgaaagaggagagaggaagaaggagctggaggaggaggggaggaggaggaaggaagggtattcccaccctgagaactcttttacattatccacacagatttctgtgcagttatatgattaattcaaggctctaatataatgtagcaaaaaaaaatcaacaaaatagaaggtactcctggacacacttaagtttcacaggttggtgtgggttcgtgtcttctcagcagcatgtgaaggtgttagatggttttttaaaaaggaggaagaggaggagaatgaggacgaggaggaagagagtggggaggtcttgcagcccaagagatgtctgacatgacctggaagttaccgctgcgcctgcaccatgggaagactgttctgggtcatcgtttacccattgtttagactttgatggctgtctatggaggtgtctccaagttcgggtaggggggcctggctctcaggtcaggaggactctggactaagtcttgaatgtttccaggtgcaccccatacaaagggtctgtctcaggactcctacagctgagggaatttacaaattcttcttcccatcttggtctgctctgtctatccccctcacctggatgtgttcctatacccatacccggtggctgtggtccaattttattctaaaagttttcactaggaacacatgctccaaccctcatccaaggctagaatcttcccagcagtttcccagggcacctgctctgagattttacctcttggggagagaaaggatgagattctagagtgtgtgttttatttatttaattttttttctaaagtgaattggaaaacaaaagaatgaacctcctcaaacttcagtatggcatggagttggactatgacaagagaagccagtggaagtatagagacatcttggacttaagaaatgctgtgtacctatggtttgacagagagtagtggattccctgacattagcctgtgtgacctgaaataaagctgcaggtgtcccatggctgagtaggatgcgggacgtcttagtgggggccactgaaggaaattcttaggtgacagagagtcagatagtggcagatcagaagatttggatagaaccaggaaacagacacgttaaaaaaaattgcagtaagaatatctaacatgagatttatcctctcaagtttttaagtatgcaatacagtattattattacttgttaactctttaaaacatttgaatagtttttggggaacaggtggtgtttggttacacgtataagttctttagtggtgatttctgagattttggtgcaccgtcatctgagcagtatacactgtacccagtgtgtcccctttgatcccccacccccctcccacccttccccctgagtcccagagtccattatgccattcctatgcctttgcatcctcatagcttagcttctgcttataagtgagagcatacgatgtttggttttccatccctgaatgacttcacttagaataatggtctccaattccatccagcttgctgcaattgccattatttcattcctttttatggctgagtagtacagaatacagtattattaactacaggcgcagtgttgtagacagcagatcagaacttattcgtcttgtataactgaagctttatacccacagaacaactccctactgcccctcctcggagcacctggcaaccaccattcatcctctgcttctatgagtttcatgagtttatactctgcatataagtgagacatggcagtatttgtctttctgtgcctggcagattctgcttagcataatgtcctccaggttcatctgtgttgttgccaatgattggttgcctttctttcttaaagctgaataggattccactgtatatatgcatgacattttctttacgcattcatccatccacggacacttagatggtttccatgcccaggctatagtgaatgatgctgcagtgaacatgggggtgcagatgtctatttgagatcttgattttatttcatttggacaaatacgagtaggcttgctgggtcacagtagatttatttttaattttttgaggaacagaaaatgggcattttttaaaaccacatctggaagaggggaggagccacagagttcatttccaacaccttcctgtatgttcttttccggtagttgtgcatagtgtatcatacataagttagctgctttgcaaacagtgtgtagttcaatcttcccttacctttggaaacaacctggtctcaaaaagcttatctgtgttgtctctgaaataacctttgggtgcagtctgtacagttaaaccatgtgaattcagtaacttgcagctaatgcttttgctatccttataaaatgaggagacagacgcttgatcctgacctagctcttgatatggtttggctctgtgttctcacccaaatctcctgttgaattgtaattccgaatggtgggaggtgattggatcatgggggcggatttcctccttgatgttcttgtagtgagtgagttctcacaagatctggttgtttaaaaatgtgtgacacttccccctttgtgcactctcgctctctcctgctgggcatgtgaagattgtgcctgcttccccttcgccttccaccatgattgtaagttttctgaggcctccccacccatgcctcctgtacagcctgtgaagctgtgagccaattaaacctcttttctccataaattactcagtttcacgtatgtcttcatagcagtgtgagaatggacgtatacagctctattgagtccaagagtcccaacttcaggcattcctgtctggggacaaacactcaccatattagtctgctaggtcccacagtcctcagaaatttattttctcacagttctgcaggccggaagtccaagaacaggatgctgttaagattggggtctagtgaggactcttttcctggctggcagatggccaccttctcactgtatcctcacatggcctttcctttgtcctaaagcagaaaggcggtggtggagatggaaagagagagaaagagagagaatgagggaactgtggttgtccagggttggcagaagaaggaatggggaattgtttagtgggtacagagtttcagttatgcaagacatataagctctgatctactgtacagaatcatgcctatagttaacaatactctattatgtacttaagtatttaagagggtaaatctcatattaagggttcttatcacaatgagagagagagagagagatctgtcttcatcttcttatgaggacacaagtcctataggatgagggccccactcttatgagctcattgagtctttattatctgctgatagactctatctccaaatacagccacattagggttagggtttccccatatgaattttgaagggacatggttcagtctgtaacacctactccagcctggagcaatgtgctctctttcctttggctgatggtcttgatggagtaggaagaacttcatcgtcatcctatacagcacctgcagatgctgggacttctctagtgggatgcagcttgtttccaaagtaagtaagtggaagtcggggcacagtggctcatgcccataaccttagctctctgggaggctgagggcagaggattccttgagcccaggagtttgagaccagtttggacaacatagtgagaccctgtctttaccaaaaatttgaaattagccaggtatggtggtgcatgcctgtggtcccagctacttgggaggctgggaggtgggaggattacttgtgactgggtgtttgaggctgcagtgagttatgatcatgccactgcactccagcctgggcaacagacggagaccctgcccccaatccc[175 bp omitted]ggtgatgggcgcctgtagtcccagctactcgggaagctgaggcaggtgaatggcctgaacccgggaggcggagcttgcagtgagctgagatagcaccactgcactccagcctgggcaacagagctagacttcgtcttaaaaaaaaaaaaaaaaaaaaagtaagtgaaaacttcaggaatgtgctgggacaggtttgaaaactcatggttttctcccctggtcacccagcactggaagctctatatgcttgaggtactttcaggtgtttctgaccacatgataagtagaattatcttttcacaccattgattgttacttctagctgggatataattggtgtgccacttacctgcacttttttcatgatgaggccaatgttattatcttataaataagtatggatcttaattgacaaactttctgctaattctatattacccttcccttctacgtccatcaggtttctatgttgtcttctaggaaacccacgaaagattgtaaagtcaataagatttaaacatctttcaaattcccaatggccagacagaaatatttgtttgcaaaaatttccccaaagaggtgcacagataaatcttttaagatgaagccatgcgaaaatataaaggaagggctgggcgcggtggctcaggcctgtcatcccagcactttgagaggccaaggtgggcgcatcacttgaggtcaggagcttgagaccagcctggccaacatggtgaaaccccatctctactaaaaatacaaaaattagccgggtgtggtggcacatgcctgtaatcccatctacttgggaggctgaagcaggagaattgcttgaacccaggaggcggcggttgcagtgagctgagattgcaccactgcactccagactgggaaacagagtgagactctgtctcaaaaaagaaaaaaatataaaggaagactggtatctgtttgtctgttgagtgttggacaatgtggggatggggaggacaggattgtctctgctcttaactttctttttaaattaaactttttttggagatgaggtcttgctctgttgcccaggctggagtgcagttgtgcaatcgtggttcactgcagccttggctgcctgggctgaagcgatcctcccagcttagcctcctgagttcctgggaccacaggtgtgctccaccatacccacttagttttttattttttgtaaggttggggtcgtgctgtgttgccccacttgtcttgagcccctgggctctagtgatccttttaccttggcctcccaaaatgctgggattacatgcatgagccactgtgcctggccctggctcttaacttttggggtaactgaagtgatgcccaccgtaggttttgagacttaggagaagactaattttttctctatggagaggaaatttatagaacataaaactcaacattttgttatttttattatttatttatttttgagacagagtctcactctgttgcccagactggagtgcagtggtgcaatctcagctcactgcaacctctgcctcctgggttcaagcaattctcctgcctcagcttcccaagtacctggaattacaggcgcccaccaccatgtccggctagtttttgtattttcagtagagacggggtttcaccacgttggtcaagctggtctcgaactcctgacctcaggtgatccacccaccttggactcccaaggtgctgggattacaggcgagagccgctgcacctggcaaaattcaccattttaaagtgtacagctcagtgagatttagtatgttcacaaccacgtctctatctagttccagaacattttcatatttccaaaacgggaccctgtacccactagcagtcacttcccattccgcctccccagcctctaatggccatgtattttccgtctctgtggatttgcctattttggacactttatataaatggcatcatatagcacgtggtcttttgtgtctgactcgtttcgctgagtgtgctgttattcaggtgcacccacactgtaacctgtttccgagccgcattcctctctagggttgcatcatgttcccttgtgtggatggaccacgttgtgtttttcttcatccactgatggtcatttgggttgattccacttgagatgttttttaacctacgactcaggacacctggactagattattcatgatttcttccagatctgcgatcttagatttaaataaatagcagtgtgccatttgggtcacagatgttagttctgtgtgaaacagatctatagataggaagaagaagtttaacgaagagaagatacagacgggctgtgaaaagtacctgggaagaaattgaaactgcaacagggaaatgatgataaagtttttggtgtgcaatggattataaaaggcgctatacaacggagagaatgtgtccttattgtgttcagaggatgagaaggtacgcaggtgtgagtctggccttgaatcttcaacccactacttcatcattattttattaaaacaaaacttcgatgcatttcaaatcattgtcttttccacattaggtaaaattacatgctatttttcatttgaagtatttttggtttttggtggagtaatgctcttatgggtctttctaattttatttatttatttatttgtttatttatttatttatttatttatgacagggtctctctgtgtcacccaggctggagtgcagtggcacggtctcaagtagctgggatgaaaagcacacaccaccatgtccagctaattttttatttttatttttactttttgagatagagtctcactctgttgcccaggctggagtacagtgctgcaatcttggctcactgcaacctccacttctcggggtcaagagattctcctcgttcagccacctgagtagctgggattataggcatgtaccaccaagttaggctaatttttgtatttttcatagagacagggttttaccatgttagccaggttggtctcgaactcctggcttcaagtgatctgcccacctcggcctcccagagtgctggaattacaggcatgagccactgtgcctggccaattttttaaaaatttaagttaaattaaaattatttaatttttaattttttacatgtttattttagactcagggctacatgtgcaggtttctgacctgggtatattgcatgatgctgaggtttgggctcctaatggacctgtcacccaggtagtgagcctagtacctggtaagtacctttccatccgctgtcccccttccttcctctcccgtctagcagtccccagagtctattgttcccatctttatgtccatgggtactcaatgtttagctcccacttgtaaatgagaagatgtgctatttgactttctgttcctgccttaatttccttaggatgatggcctccagctccatccatgttactgcaaaggacatgattttgttctttttatggctgtgtagtattccttggtgtagaggtaccatattttctttatccagtctgccatggatgggcacctggattgattccatgtctttgctattgtgaatagtgctgtgatgaacatatgtgtccgtgtgtgtttttggtagaatgatttattttcctttgggtagaaactatttttttaacaactttattgagatatagcttacatatgatatcatttacccacttaatgcatgcaattcagtgtttcgtagta[145 bp omitted]tccagggttccagcgattctcctgcctcagtctcctgggtagctgagattaaggcacgcgtcaccacacccagctaatttttgtatttttagtagagacagtatttcaccatgttgccca[131 bp omitted]tataaccaccttaacaccccctgcccccatccctaagcaaccacaaatctactttccatctttatagacttccttgttttgaattatcctttacatgggatcatacagaacacagcgttttatgactggcttccatcacttagcaaattgccttcaaggttcactcatgtggtggcctgtgtcagagcttcagtcctttttagggctgaagaatattccatgatatggatggaccacatttagtttacacattcatttgctgacaggccatttgaggttgttaccacctttaggctaccatgaataatgctgctgtgaatgtgtgtttgagagtttacgtgagcagacgtgagcacatgttttcatttctcttggagatatacttcggagtggaaacccaccatgttttagctgtgaaatattagacttgtcttaatgtctccaaacttttgtttccacatttataaaatacagtagtactttcctggtaggatttgggtggcaattatatgattgtagtttgcaaagaagttaagaagtggatggcacatcatgagtgcttcaacaatcacagctatggctattatttgtaaaaataaatttgcagaaagagaaagcctgtatagtgaaggggctagataaatgtttgaaagcacagaagagtttaccatggattcacattcctttgttgagggttgaatcatatgcccaactaacatatgttgaaagctgaacccccagtacctgtgaatggggccttatttggaaatccggtcttcacagatgtactgaaggatgtgtgtgaagtaagtgatgcagatgtaggttaaggatctcaagatgagctcatcctggattagggtgggccctgagtcccctgacaagtatccttttaagagacagaagaggagacaggcacagagaaggaggccacataagaaggcagggactggagtgatgtggcagcaagcccagggacaccgggagcccccaggagctggagaggcaggaaggatcctccacctgaggatcctaacccctttaaattcacagaacctgtgaatgggatctgatttggaaatagagtctttacagatactattcgttaaggattccaaaaggagcttatcctgggttagggagagtcctgcatccaatgacaggtgtccttctaacagatgaaagaggagacacagacacagaggagaaggccacgtacagatggaggcagagactggagcgatgcggtcataagcccagggatgcctggagtccccaggagctgggagaggcaggaaggaacctcccctggagcctcccctagagcctcccccagagcctcccccagagcctcccctagagcctcccccagagcctcccctagagtttcccccagagcctcccctagagcctcccctagagcctcccccagagcctcccctagagcttcccccagaccctcccctagagcttcccccaaagcctcccctagagcctcccctagagcctcccccagagcctcccccagagactcctgtacagcctcccctagagcctcccccagagcctcccctagagcctcccctagagccttcggagggagcgcagccccgacattccttgatttcagactcctggcctccaggaccaggagacaatcaattccggttgttttaagctactcaggttgtggtactgtattacggcagcctcaggaaagtcacttggggtaaacacatttgacacccaagaagtgcttcctgctgggcgcagtggctcacacccataattccagcactttgggaagctgaagtgggaggatttctttagcccaggagtttgagaccatcctgggcaacagagcgagaccccgtctctacaaaaaataaaaaaattagctggggctgggcgcagtggcttacgcctgtaatcccagcactttgggagaccgaagtgggcagatcacctgaggtcaggagttcgagaccagcctggacaacatggtgaaaccccatctctactaaaaatactaaaagtagccgggtgtggtggtacacgcctgtaatcccagctactcagaaggctgaagtgggagaatcgcttcaacccaggaggtgaaggttgcagtgagccgagatcgcgccactgcactccacattccagcctgagcgacagaaggagactctgtctcaag[131 bp omitted]ccaatatggcgaaaccccgtctctactaataatacaaaaactagttgggtgtggtagtgcacacctgtaatccgagctacttgggagactgaggcaggagaatctcttgagccccggaggcggaggttgcaatgagccaagattgcaccactgcgctctagcctgggcgacaagagcaaaactctgtcttaaaaaaaataataaaaaaaaaaagataaaaggtctggcccagatagaattcatggagtgtttccttccttcctcctttacaaaaagaacatcaaaacagtagcaagatgacaccaatgtttcctatcctctggggtaccccattggagctctgacttagttcatttggactgctatgacaaaataccatacagtgaatggcttttaacccatttcccgtttagaaaaaaaaaaaaaaaggtacagcttgctgcctgcactcatttaattttacataaacacgctcgctctttgaggctgaagaaaatctaattgattttcaatgtgaaaataaaatgcaaaaattgttcttagagttatttctaaacagaacttgtgtctaatcctaatgtaaaatcatatacatttctgttgcattgggattagagacaagagtattctcggggcaaatgggaaaggggttaaacaaaagacatttactgctcacagctctggagtccaggatcaaggtgtggcagattcattgtctggtgagggcttcctggttcatagacttggcaccttctcgccgtgtcctcacatggtggaaagggtgagagagctctctgaggtcccttttataagggcactagtgccattcatgaggctcctgacttcatcacgttccaaaggcctcacctcctaacaccatcacctggggggttcaattttgatttgggggtaacataaatcctgtctgtagcaagctctatcaatgcaagtcattgttagactacagatttcatcaaaatcactttgccccaatgttgtacaactaagggaatattcttcttctcaaaaaagcatttttttttttggtctccctaaaatggtaactactggtctgaaaatactcttggtcgactcatggatcatgagtttttgggaagtgggcaagctacaaaatacaaatcactaagtaccagaagcaaagcctgaactttatcatttttagctgccttttcacatgggagactgttgtacatcatttgcaggcatgagttttgcatgaaactgtgaacccaactgcctacttaaaagtaagatttgttaaaggatacaaagttacaggtagagagtgggaataagttctagtgttctatagcactgtaggatgactctaggcaacaataatatacagtttcaagtagccgagaggatattaaatgttgccaacacaaagaaatggtacaggtgtgagatgatgaatatgccaattatcctgctgtgaccactatacattatatatattgaaatatcactgtgtatcccaggaatatggacagttattatatgtcaatggaaacaacaaaattcttaaaaaaggatttggcaggatggatttttatttatttatttattgagatggagtctcactctgtcaccaaggctggagtgcagtggcaccatctcggctcactgcaacctccacctcccaggttcaagcaattctcctgcctcagcctcccaagtagctgggattacaggcacgtgccaccacatctggatgatttttgtatttttagtagagatgaggtttcaccatgttggccagactggtctcaaacccctgacctcagatgatccacccacctcggcctcccaaagtgccgggattacaggtgtgagccaccatgcccggcctctttttatatttttgaaaattgacaaaaattgcatatatttatgatgtgcaatatgatgttttgaaatacgtgcacattgcagagtggctaaattgaactaattaacatatgtatcaccttatatatttatcttttatgtgtgtgatgagaatatttaaaatctgctgtcagtgattttcaagtatgcaatacattgttgtgaactatagtccccatgttatacgatggatcccttgaacttattcctcctaactcaaattttatttgtctttgaaataaaagtgttggttgggtgtggtggctcatgcctgtaatcccaacactttgggaggctgaggcaggcggatcacctgaggtcaggggttcgagaccagccaacatggtgaaaccccatctctactaaaaatacaaaaattagccaggcgcgatggcatgtgccttaatcccagctacttgagaggcttaggcaggagaatcgcttggacctgggaggtggaggttacagtgagccaagatcacgccactgcactccagcctggacgacagagtgagactccatctcaaaaaaaaaaaaaaaaaaaaaaaaagaaagaaaaaaaacagtgtctcccgtgttaaacatggatcaagtttccttggcttttttcctaacgtaattctaattgtcttttttctgcaaaaagcagagaaagaaaatgaggctgaatgcggtagctcatgcctgtaatcccaggactttgagaagctgatgcaggaggagcgcttgagcccaggagtttgataccagcctaggcaacacagcgagactccgtgtctacaaaaaataaaaaattagccgagtgtgtttgcacacacctatagtctcagatacttgggaggctgaggtgaggcaattgcttgagcccaggagtttgagaccagactgggtaacacattgaaaccccatgtctacagaaaattttaaaaaatagctgcatgtggtggcacatgcctgtagtctcagctactcaggaggctgaggagttcaggaccagcctgggcaacattgtgagacccccatctctacaaaatattaaaaattagctgagcgtggtggcacgcacctgtagccccagctattagagaggctgaggcaggtgaattgcttgagctcaggagtttgaggctgcagtgagctgcgattgcaccactgcaccccaacctggatgacagagccagaacctgtctctgtgtctgtctctcccttttttttttcttacaccaacttcggtacattctcaaaccttttaatcgttcacccttgaagtactggtttgtcatgttctgaagctccctgtaatgggatgggtttctgatcacccttgggctgtattgggctggcatcatttaaatatccgggcatttagattggttcctgatagggaaacttcatgtttatttcacatgtaggctaattgtttggtctgcctgcgagtcctgaggaattattaaggaaaaccacacctgtttctgctttctcatcctgaggaattattaaggaaaaccacacctgtttctgttttctcatcctgaggaattattaaggaaaaccacacctgtttctgctttctcatcctgaggcattattaaggaaaaccacacctgtttctgctttctcactcgcagtgagagagttcctgggagagatgcagtacccggagggttcattatcagccccagccgctgatgcgctatcagcctgcggaggagggagccctggggcttcactaaccacgggctggagctgccacgcaccagctccagtgagatcggggttttcgttttcatccaacactttcaacccagtttctgatgaaagggcttcttccagtcaccagagaaagtgagtttgtatgtttttcctccagagcattgctgcgtggttcacaaatagggctgcttatgacaaaatattaactttggcagttttggagaaaaaggacaaataatgcattcctgggagaggtgtgcagcacatgggctgcgatgggtcacagggacaggtgcctggaaaccaggggtcaaagatgagcctctgaaacggctctctttctagtctgcatgcccttcactgctcttcctttataaagataacaagtctctatatgtcgttttagaaattgtggcaaacactgtgtgtcgttttagaaattgtggcaaacgctgtgtgtcgttttagaaattgtggcaaatgctgtgtgtcgttttagaaattgtggcaaacactgtgtatcgttttagaaattgtggctcacgcctgtaatctcaacactttgggaggctaaggtgggaagattgagcccaggagttcaagacctgcctggcccacatagaaagacaccatctcaaaaaaaaattgtgtggcaaagtatacataagacaaaactgaccattttagctattttcaagtgtacagttgagtggcattaagtgcactcatattgtgcatctgtcaccaccatccacctctggaaattcatcttcccacctgaaactctgtcccctagtaaccaccattctactttctgactccatgaatttgcctactctagaggtactgatatacgtgaaatcatacaatatatgtcctttagagtgtatttctttttttaaaaaaatgtcaacttttattatagattcagggggcacatgtgtgggtttgttacatggatataatgcgtgatgctgaggtctggtgtatgaacgattctgaagcaggttgttcatctagggtgatacctgaggtttgttgtctccggctgaggaaatcaaggatgtggacatacaagaagtgaggttaagggcggaggtttaataggtgaaggaacaagaagagctctctcctgcagagaggaggttccgagtgggttttctggtctgcagcaaaatgcaatgggttttatagatgagcttgatgaggtggtgtctgatttacatagggtgcaagagattggttggaccaggtgtgtcatttgcatagggcacaaaaaaactggttagggctaggcatgccatttgcatagggcaccaaaacctggccaccttcaccctaatcttttattatgcagatggattctctacctggttggcactatgttgcctgttcctttaaggtacacggtgacaaaagggaagatggagcctccatgttgaacgtgcctggctccaaggtagcccttttctattggcacagctgccggtattcacctgtgcaagcttccagcttgcttatctatgtctgcagcatgatttttcaggctgctctttgttagaaatgattttggagctgctttttgttaaaagagaaattccgccgaggactcttttaccctcactatctgcctgagtaatttctttctagctcctgtatgaatcccatcattcaggtagtgagcatagtacccaggaggcactttcccagccctgtcgccttcccctcctctcccgtctagtagtccccagtgtctgtggttcccatctttatgtccatgagtacccaatgtttacttcccactttataagtgagaatatgccccatatttggttcctgaattaatttgcttagaataatggcctccagctgcatctttgttgctacgaaggacatgattttattctttcttatggctgtgtagtagtccatggtgtatatgtaccacattttccttatccactccacatggatgggcaccggggttgattccgtgtctttgctattgtgaatagagctgcaatgaacatgtgcgtgcaggtgtctttatgttagaagaatgtatttgtccttgggtatataaacagtaatgggattgctgggtcgaatgctagttctgagttccttgagaactctccaaactgcttttcactgcagcggagttaatttacatctgtcaggcctctgagcccaagctaagccatcatatcccccgtgacctgcacttatacatccagatggcctgaagtaactgaagaatcacaaaagaagtgaaaatgttcctgccttaactgatgacattaccttgtgaaattccttctcctgtctcatcctggctcaaaagatcccccactgagcaccttgtgacccccacccctgccagccagagaacaaccccctttgactgtaattttccactacctacccaaatcctataaaacggccccacccctgtctccctttgctgactcttttcagactcagcctgcctgcacccaggtgattaaaaagctttactgctcacacaaagcctgtttggtggtctcttcacatggacgtgtgtgaaaacattcccatcaggagtgtatttctgtgtttagcatccatgctttgagtttgccagaagatgttggatttgattgtaccctgggagtagtggcgcatgtgtctcattcttccactttcaagttgttcattggagctggagttttacactaggcagtgatgactgaggacccccagatgaatcttggaatttgatctcagaatgtggcagaggctacatccccatgacccagcaggaagaacatgcctcctgcatcccacggctgaggagaaagtggcttttacagatagttacaggcaccaatggttctacttccctgaaaagctgtgtattttttccatgtggttctgaagtatagttgctggaggatttgcgtagaccgaaatgtaggcttggtgcaaacataattgcagtttttgccattaaaagtaatggccagactgggcgcagtggctcatgcctgtaatctcagagatttgggaagccaaggtgggcggatcacttggggtcaggagttcgagaccagcctggtcaacatggtgaaacctcatctgtactaaaaatacaaaaaatagctgggcacggtggtgcgtgcctgtggtgccagctacttggggggccgaggcatgagaatcgcttgagcccaggaggcagaggctgcagtgagccgaaattatggcactgcactccagcctgggcaacagagcgggactccattttacacacacacacacacacacacacacaaaaccgcaatcacttttgcaccaacctagtataattggggaattcctggttacttttttattccacgaaaaagcctgttcccactggggcaatgtgccagaggaagggcaggttagaactgtaaagcttcaagaagaccccctatatcctgtgagtgtccttggtattcattctgcaggccattatcagtcttgagggggctgctacaacattctatggaatgagagagcattgctgtgtcaggaagtacatactatttttttctgcctctttctctaccttaaaaggatatgctcagaatgagttgaaatatggccattttttcccctgaaatcgagagccagttgttgacttggaatcattcaatgtctccatttgttttgggttagattgtttgaatggaggattctactaccaaacactcataagatggctttgagcagaaacaaggctgatcagccggtatgtacacaattcttggctttacaatatttcttgggacattcttgggcttaaaatatggccacacctctgcagtggtaggtcaaacagcctctgtcccagacctaagctctctggatgccacaccccagactgggactcccaatctcatggttcacgctggcaatgcctgacccaggacattatcttgccattgagaccagggtccttctccttggacagttcctgtaactgttattgagtattttgaacagcattgaatattttgttgaatactgaatatttattgaatatattgaatatcttgaataacagtccaagcagaaataagtatcgggacactttgttctcgttgacagtctcaggtttcagttctggccatatgagtcttgggtggttcattattgtgaagactccacaaagtaagatgggtgtatggtgaagaataatcaaaggtaaataaaggcaccatctcgaagtggacttgccatgttgcatggaagcatgaatgtgttgagtcttttgttgttgaaaatggttctaggctgggcacagtggctcacgcctataatcccagcactctgggaggctgaatgtgttgagtcttctgttgttgaaaatggttctaggctgggcacaggggctcacgcctatgatcccagcactttgggaggccgaatgtgttgactcttttgttgttgaaaatggttctaggctgggcacagtggctcacgcctataatcccagcactttgggaggccaaggtgggtggatcacctaaggtcaggagttcgagaccagcctggccaacatggcaaaactgcatctctactaaaaatacaaaaattagctgggcattgtggtgggcgcctgtaatcccagctactgaggacgctgaggcagggagaatggcttgaacctgggaggcggaggttgggcagcagagcctcgggaggggaggaggggaggcgagagggggaggggagaggggaggagagttctagcatccccaagtctgcccttgagaatgtggtttgagaagggaggtggattctttcagtggtgttcacagagcaattgaaactttagatttctcagagtgagctagtttactaaagcctacatatctgaaaacataaacacttcttcattaagggtgccctttaagccagaaacaaactcaaccaccaaccaccaaacccacaaatgagacaaaaccaaaccaaaccaaaaatccaacaaataaacaaacaaaaaactttccctgagacaaaccacagaactttattttgggaaaagaaaacatttttttgttggtcaaactatcagctcctatgaaatactcttagagatgtttatcctgagctagttttttttgtggggaggtgctgtttacatgctatgttaaaaataacacgcaaaaattcacgagacattgatgatgatgatggttatacaaataacgagaataatgatattggcatacatcatgtgagtggaaaaaaaaagttgatggtggtgatgacaatacgatcgaaactgcttttgctccgtggaaagccctttgagatggggacctggctgtgcagtttgcggtgtatttgcctaaaacgccatctggctgctacgtagaggaagaacactgtttgcttttctggcctttgttttcataattcttcaatttctctttatgctcctaaaaattctacataatcccatttcgaacattgcattcattctctttttttttctcttagaaaacaataagggttttcattaagaagtaagtcataagactgcaagagaacaaataaaactcttaagaggtctccctccctccctctctctctgcaggctgggggtggaggattcaaacgaaattttgcttgagaaagtagcctgctcgcttcagaaaattgaatattttattcaaaaaaggttaattttgcagaaccaatttggcacacctttacatcattcacactaccttccctgccccgttatttagagaactctaagaaacataatctatacatgcacacaaagttgggaacagtagatactagggaatactagagggtggagagatggaggggccagggctgaaacactacctgtggggtgctatgctcagtacctgggtgatgggatcatctgcattccaaacctcagtgtcacatgatatacccatgaaacaaacctgtacctgtaccactcaaatctaaaataaaaggtaaaattatatataaaaaaggaatatgatccacagaatgtatcagacaaaaggtgtttgttatggtggctaatacacttggggttcagaaagtcagtggtggccacacacggtggctcatgcctgtaatactagtgctttgggaggctgaggcgggaggatcatgtgaagccaggagatcgagacctctctgctacaaaaagtaaacaaacaaaaattggctgggtgtggttatgcatgcttgtggtcccagctacttgggagactgaggtaggaggatcacctgagcccaggaggtcaaggctacagtgagctatgattgcaccaccacactccagcccaggcaacagagcaagaccatgtctcttaaaattttttttttaaagaaaaaaagaaagttggtggggacgtgaattctagaactttctctcctcaaatatttagaacaggttgacatggtacacaacgttcttaaaagagcttagcaagaggacggaggctcagcatttgaaggaagctgagtgagacagattaactaataaacaagtcaagtcaccagttaagaattggtccaggcatagttgctcatgcctatagtaccagcactttgggaggccaaggcaggaggatcacgggagctcaggagtttaagaccagcctgagcaccataggaagtcttcatttctacaaataattagcccggaatggtggcacaaacctgtggccccacctactcggggggctgaggcgggaggatcgcttgagcctgggaagtgcagtggcgtgatcatagctcactgcagcctccacttcccaggctgaagcgatcctccctgtgtcctcacatggtcatccctctgtgtgtggctgtatccttttattttcttgaagacagggtctcgctctggcccagcaaagagtgcagtggtgcgatcatagctcactgcatcctggacctcctgggctcaagcgatcctcctacctcagcctcctgagtggctgggaccacaggcgtacaccactacacctagctaatatatatatgttttctagatacagagtctccttatgttgcccaggctggtctcaaattcctggcctcaagcaatcctcccgtctcagtctcccaagtagtcgggtctaccagcacgcaccaccatgcccaggtaattttaaaactttttgcggctgggtgcggtggctcatgcctgtaatcccagaactttgggaggccgaggcaggcagatcactgaggtcaggagttaaagaccagcctggccaacatggtgaaaccccgtctctgctatatatacaaaaattaaccaggcgtggtagagggcgcctgtagtcccaggtactcgggaggctgaggcaggagaatcgcttgaacccgggaggcagaggttgcagtgagccgagattgtgccactgcactccagcctgggtgatagagggagactccgtctcaaaaaaaaaaaaaaagaaaaaaaaaatcaaaaactttgtagagacagtcttgctatgttgcccaggctggtctcgaactcttggcctcaatgtatcctctcgcctgggcctcccaaagtgctgggattacagcacttggctccagcttgacctttgttggtagaactactcagaaaatatgaccgatttagaaattgggtggtgccaagtaaaccccacccaaacctatccccgcaccagttctcatctacctttttcgcgtgttggggaactagcaaggcaggggctgccgctcgcgggggcttggcctccctcacgcagctcagcctctgagcgcaaggcacagggctctcgcgctacggccgccacccgccccgaggccccggtcccctcccctcaccgccgcaccaggacagcgcggccaagagccgggcctttcgggggctggtgcggacgtggccagagatgcccgaggagaagcaagagaccatgggtatgcggcggtcacgggcctctccggcccgggagacggacgttatggctggcagcgtctcgataccaaatgtttccagaccatatgcttgccgcttcccgcacttggaaagaccaatcgttaggcccgaggatgcaagacccacccactttgcgatggaggcagccaatccagttgctcgttacttccagtgtcgcaggcgcccttacgaaagatcctgtccaatcgctaccgggaacgtcctcctagtcccgcctcagggccatcgcagaggctgtcaatgccgtctgacccctttaccccattggcgtacttccttccgacaccatgacatgcacagcaccaggccggggcgggtcaatggcggtggcggaaacggcgggccactgcgcgggaacgggttacgcggctgacgtccgccgcagcagccg[139 bp omitted]cggtgaaaccccgtctctactaaaactacaaaaaattagccgggcatggtgg[169 bp omitted]tcttgccggagaggcgccgccgccgaacccgcagccagacgcccctcagtagcgcccgcagcgggtgccgcggctctcgcctaaaccatgggcgcacccgaggggcgggctcgcctcccgtcggccctcacagctcggctgggctcggagtccgctccgccgtcgccttcccgctggggccgggaaacgcagccgcggagccgcacagcccttgcagccggatgagaggccccgctggcctcaggacggtggtcggggcggcgggcgggggcattcgtgcagccttgtggcctgcaggcgctccccgtcggcaaagctgcgccgcaggcctcggggcgggcctaggggccaatagggggctccggggtgggcctggaggcctgaggccaccgggggtccccgggcaggtgatgggggcttgcggagcgggggcgccgacctctgacccacgagaggggcgccttcgcggtgctggtcgtagttattctcagcgtccctattatccgatttgaaatgagagcaggcggctctcgggctccgagccggagggggcgggcgaactgggagcaatgtgtacattccacgcctagaaccctgccgctgggcaaatggaggcccgtgtccctgcggtcgctgcctgggagggcgcacgaggtcccccaggcgaggtgacccacaggaggttttgtgacattgggcggcccagtcctgggggtggtgtgtgctagtggtggagggcggcctcctagaggagccgtcagccttccagggaaggcacctggccggtcggggagactccccggggctgcgggggaagctccacctcctcgagcgccccccggggagacccaggacgcaggggtagccctgcgcggagttcttggtggctccaggtgacgctgtcataggacaaagggccccgggtgccgacctcctgtggagggccctgccccgctgcggctgaggaggtcggcacccggggccctttgtcctatgacagcgtcacctggagccaccaagaactggaagaggcaggaaggaacaccccctagagcctccagggggagtccagccctgcccacaacttgatctcagattcctggtttccaatactggaaagaataaacttctgttactttcagccacccaaattgtggttatttgcttcagcatccataggaatttaaaaactaagaggtatgaattttatgttgctgccaaaaggctttttctaggacaagtagatatttaacctagatagttgtagccttttctcgtcttcattgggatcagaactcagttgatggcctctgtcctcctatctcaatgttgattttactttctctttaatcctgttctaaagcagtgacccttttaatattgcttaagtaaatatcaatgtttttctggtcagtgtgagaccagaaacctttttactttgggtctgagaaggagaagtattttccctccttctcctctttttagagatggggtctctccgctgcccaggctacagtgcagtggcataatcctagctcactgcatcctcaaactcctgggctcaagtgatcttccggcctcagcttgctgaaaagctgaaaccacaggtgtgtgccactatgccctacatatatatattttaacttatttgtagaaatgaggtttcactatgttgcccaggctcgtctcagacctctgatctcaagtgttcctcctctttggcctcccaaagcactgggattacaggtgtgagccaccatgctttggcatggtggggtatgcagtaggagagcaggggtggtggtagtgtctccatatgtactctcactaaaactggtgtgggcagatactggatgcctacttatttaggggcatctaaattcctgtgctaaattagaaaacagaggcagctcttgaaaggagtgatggcgtgaaggagagatgcttggaccaaccagcacacagcccttataaataattgatacccttggttttaatgccacgtcctcttcaacagttgttggttgaaatgacacgtgattccaggtaagcttttccagataaattgccctggaacttcagactttgtcaggtgaatcgatgtggaatttcagaatgggctggaatgtctgagatgggcatgtccgatattcagctcagtgtggggaaactggtggccagggctggttgcaagctgagttgtaggggtgacagttcacctgagaaacaaaaaaacatgcaagtcctggttcatgaggagtgatttcacaaatagtgaccatggaagtcaatgttgaaaaacaaatagattcagggcataagggtgcaggtttgttacgtggatatattgcctagcggtggggattggccttctaacccccaaacagtgaacataataccagataggtaatttttccaccctcatcccctcccaccttccccctttttaaggtgtcctgtgtctgttaatgtcattctataggtccatgtgtacccattttttttaactcccacttataagcgaggacatgtggtatttgattttctgtttgagttatttcacttaggatattgacccgcagctccatttatgttgctgcaaaagatatagtttcattcttttttatagatgcatagtattccttggtgtgtgtataccacattttcttcatccaatgaacattcaggttcattccatgattttgctattgtgaattgtgctgtaataaaaatataagtgtaggtgtctattctgataatttctttcctttgggtagataaccattactggagttgctgggtcaaagggtagatctatttttagttctctgagaaatctacatactgttttctatagagattgtacaattttacattctcaccaacagcgtataagcaagcgttcccttctttgcattctcgccaagaggtcaacgtttttctacaagacaaaaatgtagattggtagatgatagatagatcaatgacaggtagatggaatacatagatgatagataataataggtaggtagatgataaatggaatagatagatggaataaatggatagatagaatatagtaataaaatgcatctacctgaaaatagagaagaaaaagattgtgggactttccactctataaccctggagcaaagaaaatagcattaatgaaaaagcaaagaatgggaaagtaaaattttttagtcagaaccacccttccagcagaaaagaatagtgcaagcaaaatattaagcatttcatatgcatttgtgtaggctatgggaactattacaaaaaggtggatgtcgcatgtttcaatgctttttttttttcttttttttgagacagagtctcactctgtcgcccaggctggagtgcagtgaagtgatcttggctcactgcaacctccgctttctgggttcaatctcccaaatagctgggattatagtctcctgccgccatgcccggctaattttttttttctttttaatagagatggggtttcaccatgttgtccaggctggtcttgaactcctaacctcaagtgatcacctgcctcaacctcccaaagtgcagagattataggcgtgagccaccgtgcccggactcaatacatttttaatatacacagagctttgccacattttggagggttgcctagtgttggaatttctggatttttattttttatatttgtgtttctcccttttagtttgatgtaatgcaactcagtagattttcttattgaaataaaatctcaggctctctccattgcataggctgaagcaggtatgacgtaggacactggctggattcagacccttgagggaggccgggcgcggtggctcatgcctgtaatcccagcactttaggaggctgaggcaggcagatcacttgaggtcaggagtttgagaccagcctggccaacatggtgaaaccccgtctctaccaaaaaaacgaaaaacaaaaattaaccgaccgtggtggtgcgtgcctgtagtcccagctacttggaaggctgaggtaggagaattgcttgaatccaataggtggtggttgcagtgagccaaaattgtaccagcgcactccagcctgggcgacagagtgagactgtctcaaaaaacaaaaacaaaacaaaagcagacccttgaagggtgagcattttgccgtgtttcatttggcagctggctgttctgcttcctcctaacatctcaaaggacactggatggcctgagctcccgggtaccctgggctgcccagttagcattccctgggtggtgagaaaaatgcaaattgtctctgccctggagcttaaagacttctctctgtaggacctcaggaggtcttttatcaaactctgtatttgcaaggcgggaggattgcttgagcccagaagttcgagactagcctgggcaacctagtgggactctgtttctacaaaaatcagtctggcagggtggcacacacctgtagtcccagctactagggaggctgaggaggtaggatcacttgagtccaggagtttgaggttgctgtgagctgtgattgcaccagattgctacatggggatgagaggaaataagagggtgaacagatctcctgctaccgcacatgccacttttgaattcccagctggtgtttgaaggctgtgcaaggtgttggattgcaggatgatggagacccagatcattgtgaatccatgactgtgtggccgtttgcatcgactcagccttactgcagatactaaccttcattaccctctccagctatgcattggttttctgcataccacttggaatttatgttggctctgagtcatccgactctcacatgagaaagaaccaaataatgatgtgttcttttaaaagaatgtgtctgcatatggcttcttatctgccaagtgctgcaccttaggcatttatattgagagtttcaagatcgtgccactgcactccagcctgggtgacagagtgataccttgtcccaaaaaaacaaaaacaaaaacaagataggagcagacatttccaaacagctaaaatgtcctcaaagggagttattgatgtattagtctgttctcaatgctgctaataaacacatacctaatactggtaatttataaaggaaagaggtttaatggatccacagttccacatggctggggaggcctcacaatcatggcagaaggcaaaagaggagcaaagtcacgtcttacatggtggtaggcagaagaatatgtgcagggggaactgccctttatagaaccatcttctgagactcattcacttatcacaagaacagcatgggaaaaacccacccccataattcagttagctcccaccagttcccttccaccacatgtgaggattattacaattcaaggtgagatctgggtggagacacagagccaaaccatatcaattgataattagcagattaaagggaaaaaggcaaatctgttgactaagacagccttcacatttccctcagcttgactgttacacagttttcctcccgacctccttgtctattttttagttttaatttttttgatacataattgatgcacatatgttgggggtacatgtgattactaaatacactcacaatttgtaaagatcacatcattgtgatcaagatattcatcaccctacatatttgccttttcgttaagctagaaacatttaaattcttatctttagctattttgaaatgtacaatagattactgtaaactacagtcaccctgctgatttattgaacagtaggtcttatttcttttatcaaactctgtatttgcaaggcgggaggattgcttgagcccaggagtttgagaccagcctgggcaatctactgagaccctgtctctacaaaaaatacaaaaatcggcctggcatggtggcacgcacctgtagtcccagctactggggaggctgaggtggtaggatcacttgagctcaggagttccaggttactatgagctacgatcgtatcactgtactccagtctgggcaacagagcagaattctgtctccaaaaaaacaaaaacccctacttatttgtacccattaatcaaactatttttatctcccttcccagcctctggtagctaccaatctactctctatcttcatgagatccaggttttaagctcccacatgtgagtgagaacatgcagtatttttcttctgtgcctggcttatttcacttaacataatgacctccagttccatccatcaggcctccttttttcacggaggatttattttaggaaacttgcaattgtgagttctttctctacctctttgagaggcaaatcttctcccaaattttcttctagcctcctcctagttttgcaacccaggaatgcctttctcaagacttcagagccatccctttaaaatgcaattattgaaggagatgatacatctgtgtctcagtttttgtagaagggcagattcccagttttgaaaaattccaatgagccaacgcagatagctttacggcatttcctaacctcttcctgatgtctccagttccttctcagcatctcaccccggcacttaaaaactccccagccttttgtttcaatgaagttaagctcctctcttccgtattgcagtagtcctgactgagtccttccttgaaggtttaacttgtctggtgcaattttttctttgacaatgtccagatcaaatgatcccataaaaacatcgagtgtgattttagcctgagaagggggagggtgagaagatagattgggaggcagctgtgtaggcaggggacttggccactccctaaacctctcccagtctcacctgtaaatggagtgcataggcagcagtgcttctcccccaaggctggggcgatggaatcagttagactattgagggcatctggaagggcatctgtgtcagggttagtcctcagggtatggtggccaatgggtttcttttggttgactgttgacaatgcgtttgttgaatggcagcctgcactaggtgacgctgaagccacagaagacactgcagtgggaaaaccagcatgagccgctgcccccaaggaacctcgaagcccaggcagaggaccagccatcccagcccgcaggtaaagtgtgtcacctgtcaggtgggcttggggtgagtgggtgggggaagtgtgtgtgcaaagggggtgtgagtgtgtatgtgtgtgagcacatgagtgatggctagtgtgactgcatgtcagggagtgtgaacaagcgtgcgagggttgtgtgcaagtgcgtatgcatatgagaatatgtgtctgtggatgagtgcatttgaaagtctgtgtgtgtgtggtcatgagggtaagttagtgactgaatgcgcaggatgtgagtgtgcatggaacactcagtgtgtgtgtggcaagtgtgtaggcgtgtgaggacaggcagaagtgtgtcagtgttgtgatgggagtgtgaatgagtgtgcaaaaaggtgagtgaatgcatggaagtgtgtgtcaactatgaaggcatgtagtgtgtcagtgtgtgcagtgcaagcatgtgtgggaatgagtgcttgttggtgtgtccatatccaacgggtatgtgtgaaagcatgtaaaagtgtgtgtagtgtgatggtgtgtggatgtatcagtgtgtataaatgagagcatgtaaatgtgtatgtatgagtgttgagtgtgcatatgtgaggctgtgcgtgtgagtgtaaccatgagggtgtgaacgtgcttaagtgtatgtgcgtgtgacagtgcaagtgtaggtgtgtgatgcatgtgtgggtttgccagtgtatgagtgtacatggtgtggatctgaatgtgcacagtgtaaagggcatgagtgcaagtgtgtgtgagtgtatgtgaatgagtggtagtgtgcatgcatgtgtgagtgcacgctcagaagcatggatgggtgcaagcctcccctactaactcctcctccttcctgagatcaaaaaagtatgtgttttctgtgtttcaaaaatgttttaaaattatgtactgtatttaatagctcttatgactacagtgtttttctctctgcttaaagtgcagcaggggctgggcgcagtggctcacacctgtaatcccagcactttgggaggccaaggcaagtggatcagttgagatcaggagttcaagaccagcctggacaacatggtgaaaccccatctctactaaaaatacaaaaattagccgggcatggtagcgggtgcctgtgatcccagctactggggaggctgaggtgg[137 bp omitted]acagtgacactgaaatgagaattgtgtcagaaaaaccacaaacaataatgaaatggctcctatataacccatccccaaaaacccacgtaaagaagaaaacagggctgggtgtagtggttcatgcctataattccagcactttgggaggcccagaagggaggattgcttgagcctgggaaatcgaggccacagtgagctgtatttgcaccactgtacttcagcctgagagtcagagtgaaaccttgtctcaaaaacagaaagacgaaaagggtacctgaggtattaactctgatcatcagtgagtggaaagattctggtattctggtgctttccattttcttttagcttatcttcatttttgagttttctggaagagcatttattgctttttttctttttgagacggagtctccctctgtcgcccaggctggagtgcagtggtatgatcttggctcactgcaacctccacttcctgggttcaagcgattttcctgcctcagcctcctgagtagctgggactacaggtacatgccaccacgcccggctaattttttgtattttttttagtagagacagggtttcaccttgttagccaggaggatggtcttgatctcctgaccttgtgatccacctgccttggcctcccaaagtgctgcgattacaggcgtgagccaccgcgcccggtcgcatttattgctttaagaaaaaaaaatttcacttgatgggaagaagctaaaatgaggctgactaggaaaatatcattactaaaaacattctccttcattcatggactttttttttgagacagagtctcgttctgtcgcatatgctggagtgcagtggtacaatctcagctcactgcaaccttcgcctcccaggttcaaatgaattcttgtgtctcagcctcctgaataactggaattagaggcatgtaccaccatgcccggctaatttttgtattagggttttgtcatgttggccaggctggtcttgaacccctgacctcaagtgatacatctgcctcagcctcccagagtgctgggattacaagtgtaagccactgcgcctggcccttgttttggctaactctgagggaaactctttctgccatgggagattgtaccttaccattgtttatttccagggtctcctgagaacacagaccagaattactgaggtaatcttggcacattttcttaaccattttatgtgactttcaaattccttatatgtagctgggaaaaaaggctttgctagatgatctttttcaacctttgtgaagataaagattaagaaaaaagtttaaacctgaggcaaggaaaatacagaagaaaacctaaacaaagtttcggttctcagcccctgagcagccactcagtggtgggcgtttccttcactccccagtgagcacctactgtgtgttccgtatggcgcagggcagggaggagcaggccaagaaacaaacaagccttggggtcggggccacagagggcacggtgagctctcaggacagggcgggaagggaaggcagaaaggtcctgggcacaggctgggctgtcagctccagaggggtgcactgaccctgcatccatggtaagtgtggggcacaggcagtctgggctgcagcctcagagtggagcagagcccggggtgtaagaggccggctggggcaagtgggcaccaggagagcccaggctggccattatatgtggctgcatttccatttccaaaaatgtatgattttttcagttaacggagaaaaagcactgacaaaattcaacacgctttcatgattaaaaacattcagcaaactaagaatagagaaaactacctcaacataataaaattcatatatgaaaaagccacaacacactcaatggtgaaaactgaaagcttttcctctaaaattaggaacaagacaaggatgtctgcattcattacttctatgcaacacagtgctagaagttctaaccggcacacttaggcaagaaaaggaaataaaaggcatcaaaattgaaaagaaagaagtaaaattatctctatttgcagataggatcttataagtagaaatgcctaaagagcgtgtgtgcacacacacacgttagaactaataaatgaggccaggcatggtggcttgtgcctataatcccagcactttgggagtcagacgtgtgcagatcacttgaggtcaggagttcgagaccagcctcaccaacatggcaaaacctggcaaaaccccatctctacaaaaaaatacaaaaattagccaggcatggtggtgggcacctgtggtcccagctacttgggaggctgaggcacgagaatcacttgaaccctggaggcagaggttgcagtgagccaagattgtgccactgcactccagcctgggcgacagagcaagagagcgagactgtgtctgttttttcttttttaaaaaagaattaaaaaaaaaaaaactaataaatgaaatcagcaatgtagtagcatacaaggtaaatacacaggccaggtgcggtggctcacacctgtaattccagcactttgggaggccaaggtgaatggatcacttgaggtcaagagttcaagaccagcctggccaacgtggtgaaaccccgtttctgctaaaaatataaaaaattactggtggtacgtgactgtagtcccagctactcgggaggttgaggcaggagaatctcttgaacctgggaggtggaggctgtagtgaactcagactgcgccactgtactccagcctgggccacagagtgagactgaaaaaaaaaaaaaaagtcaatacacaaaaatcagctgcatttctaaatactaacaaacaatgaacagtctgaaaaggaactaaagaaaatgaaaattccacttaaaatctagcaatcctacttctggatatataccccaaaaaattgaaaggagggtctcaaggaggtaattgaacacccgtgttcacagcagcattattcataatagctaaaaggtggaagcaacccaagtgtccattgacagatgaatgaatgagcaaaatgtggtaggcacagtgaaattttactccgccttaaaggacattcagacactttctacaacatgaaccttgagaatactgtgctaggtgaaataagccagtcacagaaagacaaatattctgtgattccacttctgtgaagaaagcagcgtagtcaaaatcatagagacagaaagtagaatagtggctgccagggttggggaaaaagggaatggagagttggtgtttatggggacagttttagtccccacccccgccccgcttaccccaacttgaagctcagagttttagttgtacaagatgaaaagagttctggagatgtgtgggggtgatggccgtacaacatcgtgaatgtatttagtgcccctgaaccacacacctacatatggctaagatggtaaatgttatgctatgtatattttactacaataaaatatgttggaaaaaaaattttgatgtgataatgcaaacttacagcgactcacacctgctttatcgggagtttcagaaggggcaggagggagaggacacgctgagcagccagaggctattgacacaccagaagcatccccagggactgcctttctcaacatcaccctctgtaatggcagcgtcagccaagagcgcactgccattggttttactgaccaaacctaaagaaacggctgcgttcccatcagatttgctcactaaatcatgccgacacacagacatgcatcttccagcctgttcggcagcagtgcagacaacatgaggggtctcagatcctccacaagaatgattctggttctgcctgagccttcgcctgagcccccatcagacattgtaaaggtcaacttaaggatgatgggcaggcagaggcaggaataaggactgatatggttgaatctctcattgctctagcaccatccgcttggtgctgctctcatgatagctggttgtttaaaagtgtgtggcacctgccgggcgcggtg[131 bp omitted]tggcgggcgcctgtagtcccagctactcgggaggctgaggcaggagaatggcgtgaaaccaggaggcggagcttgcagtgagccgagatcgcgccactgtactccagcctgggcgacagagcgagactccgtctccaaaaaagaaaaggaaaaaaaaagtgtgcagcacctaccccggccccttgtccctgctgtggccacgtgacatgcctgctcccactctgccttcaccgtgactgattctgaagcatccccagaagctgagcagatgccagcaccatgcttcccgtacagcctgtggaactgtgagccaactaaacctcttttctttataaaatacctggtctcaagtatttctttataacagtgtgagaatggccgaaaacgacacccagatgcaaacattacctgcaggccaccgcgtgctgactctctcaccaagcaggagcgggcccctccctcacgcggagccgctggcacggacagccccgggaaggtcaggctgagcgtcctttcctctgtgcacccccggagggtgctcccattggctttctcagatagcaccatctcagggtccagctggccatggcctggattaagtttaaaatgctgggccagtccccacttccctatatatgactttttacaagtctgacacttgaagcttttgggcctcagggagcagcttgataagtcaaagagcgcctgcctctccctctgatcttcttccacactgacttctgaatcatcatcagaatctggcagatgaccgtcggccaaatcatccctttttatgaactcagctttagctttatacttggcaggtcgagatacctgtctcaacgtgtcttcacttttaacgatggttttagtttctcagtatgttttgtatgcaagttggaaataaataaacgtcctgaactggatgaaacatgttacagtcggcaaactggaggccgacgaaggggtcaacatggtgccctgtccatttggagccttgggggctgggactctctttgcagggaccacctagagggctggcagtggtctctgtacaaacccctgagcaggaggctgatgtaggaaacatgactgtggctcggttctcacgaggggctgtaccctgagcagctgggggctggtgacgtggagtcccaccaggcgggaattcccccggggcggctggctctgtcttgcagattggggctggactgtggccagtagggacgttggccattcctgaccttttgtttctccagacgttaccttgacacaaatggcttctagttgctttcctacagaaagacaagaaagggaaaagaagcattgtgcttatcaacatgtctgcaattttgctgtcatagtaaatccactactgacattttttctaaattacgtcttacatatacaatttatgtaacgtgtttgtattaactgtttttcagacctttctgaccagaaaccacagtgatacaagccgggcgcagtggctcacacctgtaatcccagcacttcgggaggccaaggtgggcagatcacttgaggtcaggagttcaagaccagccaggccaacatggtgaaaccccttctctactaaggatacaaaaattagcagggtgtagtggtgcacacctgtaatcccagttactttggaggctgaggcatgagaatcgcttgaacctgggaggacgaggttgcagtgagccaagatcgcgccactgcactccagcctggatgacagagcgagactccatctcaaaaaacaaacaaaatggccgggcacggtggctcacgcctgtaatcccagcactgtgggaggctgaatcacttgaggccaggagttccagaccagcttggtcaacatggtgaaaccccatctatactaaaaatacaaaagttagccgggtgtggtggcacattcctgtactcccagctacttgggaggctgaggcaggagaattgtttgagcctgggaggcggagaggctgcagtgagccgagatcctgccactgcactccagcctgggtaacagagctagactcagtctcaaaaacaaacaaaaaacaaaaacagaccacagtgacacattttacattatgacctagtatgcacgtatataaatatttgcatacataaatgaaaagctgatggaactacttagcattcctatgtaaatgcctgctgattgtatctattcttcatttctacatcacctttttttttttttttttttttggagacggtctcactctgttggccaggctggagtgcagtggcgcgatcttagctcacggcaacctccgcctcccaggttcgagtgattctcctgcttctgcctcctgtatagctgggattacaggcacacgccaccatgcctggctaatttttgtattttctgtagagacggggtttcaccatgttggacaggctggtgtcaaactcctgaactcaagtgacccgcccgcctcgacctcccaaagtgctgggattacaggtgtgagctaccgcactgaccctaatctacatcactttaaaaaaaatactagtcataatccactaagttgatttcatgatgaattaagagataataagagccttctcaacagtttcacccatgtgtttttgcttggagtttttagtactctaaaatcagatgtaattcataatgtgggaccatgtttttaaaaaagtttctaatgaaattctagaagccacaaaaaagccataaaggacaatgttacccaggatcctcctgcccaacctgcatgcccgtttcttcaccctgtcctgaatgtgctgttcagcattcttatgctttttaaatatttacatggcatatgcagatatttctaaaaatatacagttcagttctgaaatgctttaaaactttatagaaatgatatcatctcctgcaacttgatagggcttttttcaggtttctttactccattttgctttgtgaattttaccctcattgacatgtgtagctctcaggggttgattttctctgcagtatgagtttaccaatctcctattgatggatgggtactttccaaccttctgctctaaggtctgctctgaatctccacggatgtatgtgtgtacatgtgtgagtttctccaggggcatgtatctaggagtagggctgaatatctttttctttttttttttttgagagaaggtcttgctctgttgtccaggctggagtgcaatggcatgaactcagctcactgcaacctgcgcttcccaggtacaagtgattctcctgcctcagcctcccgggtagctgggattacagacacgtgctactacgcctggttaatttttgtatttttagtagagatagggtttcaccatgttgtccaggctggtctcaaactcctgacctcaagtgatctgccccactcagcctctcgaagtgctggaattacaggcgtgagccaccgtgcccggccgggctgaatatcctcaacaactttttacaaatatatctaacaaaatttcaaatacatgtgctttttgacccagtaattctacttcctggattccaaaattaaaaaaacttagatggccataaagatgttatgttctatgaggttcaaggcagcactgtctgtaatagcaaaacacctaccaaaggggagagctaccttcgacaacatcccacaaatatttattgagtactgaccatgtgcatgagacactgctacaggtgtcagagaaacagttctcatacagcttaggggagaaggtcaggaagcaaaagaaacaaggctcctgccctcacagagcagaaataatgagcattttcctccagggagaaaaagaggcaaacctcgtcatccagagcatgatttcacaaccaacatttcagaacataatcctttgacatgggtggctggaggatgcccagcagcatctctgcctctacccactagatgctagtagtgatcccaagtcctgacaagatattgccaagtgccccttgtggggcaaaactgtcctcggttgagaaccacttatttgggaccaccaactggccctctttggactcaaccttctggtgtgaccctcaaacagtagaaagtcaataaaaatgtcaaacaagacagaataaagaccctcactgagatcaggctggagtgtgtctctcgtctggctcttgttatacactagtacaaataacagaggtcaagtgtaccgaggtggcaccacaaccctgggagtccccattcctgggctacgtgcaaatcaaatgacaactagattggctgtgcatatccttcaagaacgatgtctgtttcattttactaccaatcacatagaatctctctctaagggccaaacacaaatcacacctgcagtagcagtgctttgggatgctgaggtgggaggattgcttgaggccaggagttcagggccagcctgggcaacagagcaagaccctgtccctacaaaacgttaaaaaaaaacacaaaaacccaaaacaaagagtctcactgttgcctaggctggactgcagtggtgcattcttggctccctgaaacctctgcctcccgagttcaagcgattttcctgactt[131 bp omitted]ccgccgcctcccaaagtgctgggattccaggggtgagccaccgagccccgcctacaaaacattttaaaattaggcttgatggtacatgcctgtagccccagatactcgggaggctgagggggaaggatcgtttgagtctgggagtttgaggctgtagtgagccgtgatcagtccagcctgggtgagaatgcaacaccttgtctcaacaaaaccccaaaacaacaacaaaatacatatacacacagacacacaacctaaaccctattgttttaggataaccacagcagcaaagccggcctaataatgtattcatcctctatcctgactggcttaccccgtgggtattacgcctcatgctttcttgtgtgtttttattttgtttggtgaacatttactaaatatttctggatggaatacatacacactagccaactcctagcctcacccttgagatggtgggcagtttccctgccatgcctcagtccccgcagacctgctgaatcgatctcctgggtcggagacccgatctgccctttcaaaagctccgctgacgatttcgaaggcagacaagtttccctaaggaatgcagacaggtgaggcagacgggaaaaatgtcatcatggtacaacaggtgcaataaagaggcagaacagaccagaagcagtgatctctgaggggcgttttgaaggctgggaatttttgccaggtagggcattctgagtacaaagaaaaatgtgtacatgcatggatgcatgaaaaggggttggcatgttggatggaactggacatttctggggggtgggaagagggaagatgcggagagacaggggcctccatctgacccaagtgtgtccactggtctgtgcttctgatccacaccatcccccacagcgaaccactgggcagtctgctgtggttgttgaaatgcaccccgccacctgctccagaacctgcctctcctcttctgcattttcaactcagactcaccctttcaaatctagttcagataccacttcttcaacaaagctgcttgtgatttcctcggccagaaacaatctccctttctctaactacatttagttcttcatcactagctttcaggccttgattagcaggtatctgggtcatgttttatctcctgttagttcatcagctactgaggggcaaagtacacatccggtttgacttcgtggcttccacgacacagctggggctgaaaaagtattagcagaatgtgctacaaaggtacattattggaggtagaatttatacgtctccatcagattagctacagaataagtcccatcatgctgcctgatcttgactaagtttgcttttactttatgaaaagtatgtcattttttactccattccaaacccaaaaagctgtggccacatacagcagggtgtgctggggagaacaagggctctggagagcagccacacctgagggatcttggacaaagccactcaacctccctgcaaaatgctggtacaaaaacactactgcgagctaagcaacccagaacactgcccggcacagagcagaggctcagcagatggctgtcccgggatggcgtcttgcagccttcggacccagaccacagtccaaaaaggtcgagttgcccaaggtcacacctctagatagtgtggcatttgggcagaatcatacttgccttcctaaaccttagcaagacaactctccactcttgatgatgaactggatacaacaaccccaggcagctaaaatcacgagtgaagtcgaaaaaactcaggagtgaagatcgctgattctattctctaacgcatctcttctagtggaaaaagccctcttcttttggcaattttgggttaagactaattttatttacagcgccagcaatgaaatgagatggaattttacagacgccgtgtaggacccctggaaggacaatgagagtacccaccccaaaagcatagtatctgtatgcaaaaacagtgacagagacagagagagagagagaaagaaaatgctgagaagcagcaatgaagagaagaaaatgctgggccgtggcacttgctgtgcctgagacctgaaaagctcagttggttccttttaattcattcaggtctcaggggcagcgtctggcctacgggcccacccactctaaagcggccccctgtccctcccagaacctgcctgatgttcgttcttcgagtgtgttgaaggccgcacctcctgcacttaggtgggagtgcgggcaaccccgtctctgagtgccccacagaggctgaacgagtggtcaaaggcgtgtcagacgagctaggcagcacaggggagccccgggcagggctgtggaggcagagagggcacgacggcgtcccaggcagagggcccagcgtgagcatcggctcctcaagtgaggctcctggggtgaaaacgccagggtggtggcaggtgggggccgaacgccgtccctaaggggctcagcttcgggacaccctgagtcttgactggggccggatactggccaccccggccaagcagctaaccccgccgcggggcctcggccccctccgggcctcagtttccccacgtcgctcccggagcctcacctggggcggcagcaggcgtggcgggcacgggggctcggcgccagggtcccgctggagggcggcctgatgggccgcggcggcagcagctgcgccttcgtcacccgcttcaggacctgccgcagctgctcggggcccagcggggccacacgtgcaacgctgccctggcccggagaagcctggccgccgcatccgccgcggcggctgaagcggggactccaacctgggtcgctgggcgacgacgtgcctcacctgggaaagcggcgggctacgagtgccccgcaggccaagacacctcggaaggcgacgctgcccggccgggacagccgccgcggcccctagggccgatcagcacagcggacccaccttattttctcattgcctgtcacggatgtgtttaacactcagatgtcacctcctccgggagctgtccccgatctcccaggcggaggtctttgaggttccaaagcccctgacccaaaagttatcacattctttgaggttccaaagcccctggcccacaagttatcacgttatccacgtgttctgacgtcatcgtgcaccccaatcagcggaggatcctgcctggatacgcggagtcctaggtccaccagcaaacgtttaggtttataaatctgagaggggacccaaagtttgaatttttaacaagagcgcttcccaaaccccaaactgttcccatgtcaccctaccgtctctcccctcacccacccaggctgcgtgtaccttgaagggagagacgatatgttactcattcggtgcccattacaggccctgcccagaacgcacgctcaaggcgtgaaagatggatggatgcatagaaaccaataaatgaacgggtgaacaaatccacgaacccaccctctccacatgtccgtcccatccatccagccccagtgccccgtcttcctcagcccgatcgcctctcttacagggtcgaggctctgtgcaccctccccaccgagtcttgtagctgcaggtgtgtacacacgtcccagtcccagtcccagtcccagtccctctccccagggagcgtaggaggtccactggccaacaaacacttattaagcgcctggtgggtgagtcgccattccctccctgtggggtaccacgggtctagctggcgagaaggaggaaaccagcatttgcagtacagtatgatgagcaccatgaagccaggaaaggtaaggctgggggggggggggggcgccaggctggtgtcagagaaggttctggaacatcaccatcatcctcatcaatacttcgcattcacgatgctccctgctattttttaatggtgaatttcatatgatgggtatcttaccacatttttttttgtttgtttgtttttagacagggtctcactctgttgcccaggctggagtgcagtggcgccatctcagctcgctacaacctcgacttcccgggctcaggtgatccttccacctcagcctctggagtagctcggactacaggcatgcgctaccatgcccagctaattttcgtttcttttttttttttttttttttaatagagagaggatctcaccatgttgcccgggctggtctccaactcctgggctcagatgatccacttgcctaggcctcccaaagtgctggaattacaggcgtgaaccactgcgcctggcccaagtcaatctttcctagttccttcccaagaagggatttatgacaactgagttcttttgagatcttatgggaagctctgcttttcagcagacaagaaatttcaggaattcaaatgccttctgctcaaaataattttcacgccaccgtggcacattctaaaccccttcaagttcaggaaacttgagggcagcagcctccaccgactcctccgtgctctgtccctgcatctaacccggcacgactactgcaagatgtgacatccaacttgttgcgtacaggtttctattgcaggtgtcagccgacccaggctctcctaacgttgcttatagtagcagcagcgccaccagccggcgtttattgagaactttcactacaccctgggcacttaccaaggttttaagccagtagtctgtagattttgagcagctactgatttaggtcagagttagtagatgtttccactggagagttttcaaaagcaggtggagcccctgctggatcgtgacagaaaatggcactgaccctacacaactggcttcgttcaacggagcacacctgaccaccccagaaacttgaaccaccagcgagaaactcatccacttgctctggctgcaaaatgcagaaccaagaggaagaaatgtgaagcctaagatgtctctgaaaagaaacggggggtgggggggaagagcaagagaaggtttccagaggcttccacaaccagaacgcctctctaaaaacatggcaggcatctactggctggtcactttctccacgtggcttgggatttgtgtctcacttaccgctttgctccccgcctagaacggtgctgggcatgcagtagccctacacaccatctgtggaatgcattcattgcagacctggattttcaaccctaagacttccccgcaaggcggccaagggaacacgaggcggtgacatctgggagcacccgtcttcactgggtgattcctccaggggagccacagcctcaggaagcgcgggggcggcaggggtgggggctgagggccggagatgtggatcgctttggatatcctgagtggcctgcaggtggcggagggtgcagggactcgggtgcggagccaccgccccagcgcatgcctggtacctcccgctctccccagcaggctgccctcgacaacctctgggcggggagaccaagagatcctgcagttcgctcctacccgcacgccgctcacagtacccgaaaggcgcatttttcacaaactgttgtagaaagagttcatggcggggtggcggcgggaaaaaaaaaaaaaaagctaacgccgtggccggtgcgggagtcgagcccgcgaccttggtgttatcagcaccacgctcttaccaactgagctaaccggccgcctgacggcacagtgcccctggagcgtataaaagggctccacgttcgcgcccgtccacgagcgattcctcgccaagcccgcgcgcctctggctgccttccgctttgccccagccgcggggactccggggaggagccaccgccccagcgctggccgggtttctcccgctcctccctgccaggctgtcctcgacaacctctgggccgagtccaagagatcccgcaagtcgctcctgcccgcatggggcttacagaacctgaaaggcgcattttgaaaaagagttgcagaaacagttcatggggagaaaacaaagaaacaaaccaacaaaaaactgggactagggccggtgcggggatcaagcctgcgaccatggcggtatcagcaccacgcgctcaccaactgagataaccgaccgcccgaccatctagtgctgcccgagcgtctgaaagggctccgtgttcgcgccggcccgcgactgattttcttgcagagcccgcgccactggctgcctccccgcttggccccagctgcgacttctgaccgcctcactgtcatccccattgggtggatgcagaaactgagacctaggagacttcaaggagaagggagacggcttcctacagggaaccgcaggcttccacagggaaaatgcaaattgcacatgggaggcttggctctgcagtgaggttttcaaacattcccattcaatgctggttttaactctgagaatcctgaggcctggcaacttcgtgtatcaagagcctttcagcatggttaaatctagctcagaaaacccagaaaaccaaaggccaaaagaaccaccgaattccctattgcccaaaaaataacggctgcaggggtctcgacttccttcttgtccatttttatttcctttcactgtacacatgtatttctatatatatacacggaatccttgcgccaggagtggtggctcttgcctttaatcccagcactccgggatgaataaataaatgaatggaatggaaagccttgcttgaaaaagtgtattctgtcttcctttttgcatttaatagtctgtcattaagtatatcccgaaataattgcaaatgtcattttcaatgattcattcaaaaaaaagaaaagaaaaaaaatgagacggggaaagacagaaatagagaaacagaaaatgatattgtttggccatgtccccactgaaatctcaacttgaattttatctcccagaattccctcgtggtgtgagagggacccaggggaagtacctgaatcatggtggccggtctttcctgtgctattctggtgatagtgaataagtctcatgagatctaatgggtttatcagggtttctgcttttgcttcctcctcattttctcttgctgccaccatggaagaagtgcctttcgccctccgccataattacgagacttcctcagcctgtggaactgtcagtcaaattaaagctccttttcttcccagtcttgggtatgtctgtatcagtggcataaaaacagactaatatagtaaattggtaccgggagtggggtattgctgaaaagatacccaacaatgtcacagcgactttggaattgggtaataggcagaggttggaacagtttggagggcttagaataaggcaggaaaatgtgggaatgtttgcaacttcctagagacttgttgaatggctttagccaaaacgctgatagcgattatgacaataaggtccaggctgaggtggtctcagatagacatgagcaacttcttgggaactggagcaaaggtgactcttattatgttttagcaaagagactggtggcattttgcctctgcccgagagatttgtggaactttgaacttgagagagatgacttagaatatctagcggaagaaatttctaagcagcaaatcattcaaaatgtgacttgggtgctgttgaaagcattctgttttaaaagggatacagagcataaaagtttgaaaatctgcagcctgatgatccagtagaaaagaaaaatccatttttggggggagaaattcaagccagctgcagaaatttgcataagtaggaaggagtctaatgtctccaggccatgtcacagaccttcacagcagcccctcccatcacaggcccaggagaaaaaagtggttttgtgggctgggcccagggtctctgtgctgtgtgcagcctagggacttggtaccctgggttccagctgctccatctgtgactgaaaggagccaacgtagagctcaggctgtggcttcagaggatggaagccccaagcctgggcagcttccatgtggtgttgagcctgcagatgcacagaagtcaagaattgaggtttgagcacctccgcctagatttcagaagatgtatggaaatgcctggatgtccaggcaaaagtctgtggcaggggtgaggccctcatggagaacctctgctagggcagtgcagaagggaaatgtggggttggagcccccacacagagtccctactggggcactgcctagtagagctgtgagaagagagctactgtcgtccaaaccccagaaaggtagatccaccaacagcatgcaccataggcctggaaacacaacagacactcaacgtcagcctgtgaaagcagcagggagggatgttgtaccctgcaaagccacaggcacagagctgcccaagaccataggaatccacctcttgcacctgatgtgagacctgtagtcaaaggagatcattttggagctttaagatctgactgccccactggattttggacttgcacgggccctataacccctttgttttggcctatttctcccatttggaatggctgtatttacccaatacctgtatccccattgtatctaagaagtaactagcttgcttttgattttacaggctcataggtggaagggacttgccttgtctgactgtggacatttgggttaatgctgaaatgagttaagactttggggggactgttgggaaggtacagttagttttgaaatgtgaggacatgagatttggaggggccggggtggaattatacggtttgactgtgtccccactgaaatgtcaacttgaattgtatctcccagaatacccacgtgttgtgggagggactcagggggaggtaactgcaatcataggggcgggtctttcccgtgctattctcatgatagtgaataagtctcacgagatctgatgggttttcaggggtttctgctgttgcttcctcctcattctctcttgctgccgtcatgtaagaagtaccttttgccctctgccatgattatgggacttacccagccatgtggaactgtaagtcaaattaaacctcctggccaggcatggtggcttacacctgtaatctcaacactttgggagggtgaggtgggtggatcacctgaggtcaggagttccagaccagcctggccaacatggtgaagccccgtctctactaacagtacaaaaattagccaggagttggggcacgcacctgtaatcccagctactcaggaggctgaggcaggagaattacttcaacccgggaggcagaggttgcagtgagcctagatcgcgccactgcacttcagcctgggcgacaggagcaagactccgtctcagaaaaaaaagaaattcaacctccttttcttctaagtctagggtatgtctttatcagcagcgtaaaaacgactaatacagagagtaatgcataaagacacagaaagagggagagagacaaaaagagaaagagagagagagagagagagaatgtaataggagaaagggagggacaggagaaaaagagagggccctcttcccactatccttccaaaatcagggtttcctcatgaccccttcctcaaggcctaggtgccaaaaaggtcactgaaggaagcacagtcccctcttcctcagcaggcctgaaggctcctgggctatggctgctggtcttcctaagccagaagctataaccctgagccattgggcttcccagcctagcttcctcctgtccaaaatgagaggacaaacaggagttagagagcctgagaagacctgtcccagcaacacaccccgctaagaaggcacaggctgaccactgacaactgtttaaatccagcgcccacgttcggctgggatattctgacccactcagggctgccccataaaccagcgcgtggtccggatccaagcgcaccgagaactcgaaacctctctgtcaagctgcccattgggagttaagttcaaagaggacaaaggaaacgagataaagcgtccaatacaagaattacccatttcagacgcacaagacgaagagcacaggcggtgtcaggacatgttaggatccgtccccaactccgccgtcttcatccccacaaagccacggaacacctgtaccccggagcccagctgctcctgcagcccctggagaaatctgtacattccccgccgaggaccctgccgctgggcacactgggaggctggcctgagggaccccgcgcccgtgtccctggggccgctgcctgggagagcgcacgagttaccccaggcgaggtgatccacaggaagtttggtgacgtcggatggcccaggccccagagtgctgtgtgtgctgggggtggagggtggtccccgacaggagccgtcggcgttccagggaaggcacccggtcggtcgggggactcgccggggctggggggtgcgctctacttctccgagcgccccccagggagacccagggcgcaggggcagccccgcgctgggatcccgagccgcagcggcggggcagggccctccccaggaggcgggcacccggggccctttgtcctacgacagcgtcccggccgcgccgcgcgcccctgtgggccgagtccccgcgcgcactcactcacccacggtgaccagcgtgtcgaagtcttgaaggcggttggcaggcggctccggcgaccgcgcctcggagctggggcagagctcgggcgcccagtccggggtctcctctgccacggccgcctgggccagcccgggcgccttcatggggacgcactcaggtccggggcgccgggccgggccggagcgctcggggagccgggcttccgcggatgcagcctcggagggcggcgcggcggcatcaacggaggctccccatgcgcgccatgcggcttgtggaggccatcctgcccacccggcccggagcccgcaagacgccaatgcgccttccggtgcgcgcgcggccgggcgcggctgacggagcggcggggacaatggctggccgtcgctcacggcacaagcagcaacggccccaggtagcagcagccgccggcctcgtggggcgggcacggagcgccgggaggcggcggggaaggcgggggccgcggcccgggcttgtagagccaggcgggggccctgcgcattcccagtctcgcgcccgcggcctcctgcagctcggtagcagcgtgcgcgttgaagaggcgggcggaagccgcctgggcgaggcctaggggctgggggcgtcgccttcgcacgcgctccgcccctgccgcgacccagcccaggagccagagacctgggcgtgccccgccaccgtgggcaggcgcggccctggggaggtgctcacgccccctccgcgcccgaggcgcccctcgggtggcacccaggacgacctctcaccccgacctaccgccccgaccctcttaggcgcagaggcgcacaggtccagacccggctactcaggagggaggaaacattttacaacctgttctctcttgtctttgaagcctgctagctaaaagcttcatctgcatagtaaaactttggtctccaccacctcttatcacaacccagacattcccttctgtgatctcaggtcttcagataaactcaaccagctgtcaaccagaaaatgtttaaattcacccacagcctggaaccccctttcctccaccccctcgcccccacccaccacttctacttgtctcttttctggaccaaaccaatgtatttctcaaatgtatttgattgctgtctcatgccttcctaaaatgtataaaaccaaactgcaccccaaccaccttgggcacatgttctcaggacctcctgagggctgtgtaatgggccatggtcagtcgtatttggctcagaataaatttcttcaaatattttacagagtttgactctttttgttgacaccttttcttagacagctactacaagatgttcttcagaaaatggacggcgcaaactgagaacaagtaagaggtggattcagaaagttaggagatccggtggaggagagaagtgtagttggtggccagggtgacagccattcaccaggttccatagacaaacagttcatgttggagatggggttcaagagatgctagacggagccgtccaggaagaaagagcaggaatgaatggacaaaaagtatgggagttagaaaaactgatgaatttaggggcacatggtaggccttttggagcactgggataaaatagtttcaggcactaagtaaattttatataaaaagaaggcagcccagtgcagtggctcatgcctgtaatctcagcaactccagaggctgagttgggaggatcacttgagctcaggagtttgaggctgcagtgagctataattgcaccactgcactccagccttctagcttgggtgacagaccctgtctccaaaaaataaaaaggcaattactaactccaggaaaaaggaaagaaagaaaacataatcattgtagtcactggttcatctttgaatatcattgcaatggtcattataatggaaacactgatgatttcttaaaccaaatattgtgacctaaatgtttacaagaatgtggtaggagggaaaggacatttgtgattggatggaaaggcaggcaggagagtgtcacagtctgaggggttcttctttcctgctgccccccaaaaacccagtgcactgagaacagcagatgttgcagcaaagagggaggttaataattgcagggacagctaattgagaagaataggagaggtttctcaaatctgtctccctaaaaagttggaaactatggtttttcatggtacttttgtgggcagaagcctggggaactgcaacaactgatagactatggatgaaatctcaggggtgtctaaaactgtctttctgcaggtgagttagttcccaggagagggtatctcaggaccaggtggcatctcttggtctgccaaaatgctaaatctgaaaaatatttcaaagaccattgtttaggttttacaatagtaatgttatctacaagagtagtttgggaagttatacatcttgtgatccctggttacatgactctggtgcagtgaacaacttacatgaaaacacactaagtgatggcaggtcattgattaactatgcctattctttagcaaagttcaagcccctacagtaattctaaccttgttttctgaatgtggctttaatctgcagtcaaggagtggggtcagtttccttgcctcagagtttaactctctctctctctcactctctctgtgtgtgtataaatatatatacacaattatttactatttatttatttatttattattttttgagacacaatattgctctgttgtccaggttggagtgcagtggtgtgatcttggctcactgcagcctcaacttcctgggctcaagcgatcctctcacctcagcctcctgagtagctgggactacaggtgcacaccaccatgcctggctaatttttgtaaatttttttttgagaaggggtttcactatgttcctgaggctgttctccaactcctgggctcaagcaatcctcctgcctcggtctcccaaggtgctgggtggcaccacacctggcttcaaattttaactataaactaacttcctcacgcagttatcttggctgccacactagaataagcaaaaacaaaacaatttagcctgtgaggtctgatggaagatggagtcagtcacgttagatttctcatatttgtttttcttttccttttttttttgatggagttttgctgttgttgcccaggctggagtgcaatggcgtgatctcagctcactgcaacctctgcctcctgggttcaagtgagtctcctgcctcagcctcccgagtagctgggattacaggcacccgccaccatgcctggctaattttttttttttttaatagagacggagttgcaccatgttggctggctggttttgaactcctgacctcaagcgatctgcctacctcagcctcacaaagtgctaggattacaggcatgagccaccgcacccagccaagatttctcacatttcttataattctgcaatctcagtttcaagaccaaatccccaataaccataaggcgtaaaattgacaaatcttgaaactgtagtgtaagaatattacatagcaccatgattgtaaatatgaaaacaaacatttaaaagattgaaattgaatagaggctgggaatgggacattttgatacaaggaggtttttttttaagtactaactctttcatatttcctttacaataatctgcttaaactttaagaacatttggaaaagaaggtgtcacagatgttcccttccagtcagacacgtcttcacttctttggttttactcctcttctctggagagatcatggcagagcttggcaccgtatatatactcatggggcactgatggcagtggacatttgagtgaggcagtctttgttttttacttttggagggtgattgtgaagatgaaatgaaataacccacatggcaatgcccacaattcacaaggcacataaacagggtgtcaggaaatactagctcagcagagattctacattcatcttttccctgagaatgataatgagggatgtttagtactgaaatcagaaagaatcaaaacacaggtatatctacatattcttagatacagcagaaatgtgttagtttttctctgtcctggaacagaagcagatgcagagatgcaagtgttaaaaactgcatggtagaataaatactccatacacttggagtggccacatttagcaaataaaaattgtaataaatttaaatttcagataacacattttaaaatgttttaaattttaattatatttattctacttttttatttttattttttgagacagggtctcactctgtggcccaggctggagtacagtggtgtgattacggctcactgcagcctctacctcttcgggctcaggcgatccccacacctcagcctcctgagtagttggactacaggtgtgcaccatttcgctcagctaatttttgtatttttgtagagacagggtttcaccatgttgcctaggctggtcttgtactcctgggatcaacaatccccccacctcagcctcccaaagtcctaggattccaggtgtgagccactgcacttggccaagtaacagatttttgagtatcagtatgccccatgtcacactgggggcatatggatactaaaaaattattcagtatttatctgaaattcacatttaattggtgttgtgtcttttatctggaaaccttatagatggctgaatttgcagctgtcatgtcactgtttgtggcttaatgaaggaattcatttgccatttacaaaaattcagtacccagaaggagaaaggggatgctgtttggaagaacatgatgtcactgccaatgctgaattaacttggtggtctggaatacacaatctgtgagcatcagtctctgtttttgtttttgtttttgtttttgtatttgtttttgtttttgtttttgagatggagtcttgctcagtcatccaggctggagtgcagtggcacgatatctgttccctgcaacctctgcctcctgggttcaagtgattctcctgtctcagtctcccaagtagcttggactacaggtgcgcaccaccatgcccagataaattttgtatgtttagtagagatggggtttcaccatgttggccaggctgagccttcagagggagtgtggctcggaccgcaccttgatttcagacttctggtctctagaaatgtgagaatgcacatttattgagactcattcagtgtctcaatttatggaactttgttaaaacagacctaggaaaataatactcccaatcagaaggacagaacaaacaagtggaattgtcaacacaacacaaaattggaggtatgtaccttttttagcagtaattgtatattaacttgctcttccaaagtggtggtttggagaatggataaacccaagtgtcaaggatgaaaataatgatcaattgaactccatatggaatataaaccaatttcaccctctcaatataatatgggtaattatttactcttcatgttgatttaatatttgcttttatagaatgaaaaaatataggtacactcacaactaggggccctaatcaatgatcatttatcatgagcatttgattttcaacacattatgaattacatggtggtatagtcaatgcagctcacaatagtggctttgaatctgcattgcccctggccatatgaccttcaacatatattttgaggttgggggaacaggaggaatattttttacgaattttgtgtttgatccaatatggttgtttttgaaagggctgtgtgaccctctgtggaaataaaattgatttatagctgaactggacaagctctatctatctcttgcaactactagaggtctggtctttgacccacggtcagtgggttttatgagatgttgcttaaagtctcatactgggcttggtaattgtagaatagagtggttctttgctttgcatggtgggataagatttcttttttaaaatttttaattttaatttttaatctttgtagatacatagtaggtgtatgtatttatggggtacatgagttgtttttgttttttatgaaacagagtctggctccgtcaccgaggctggagtgcagtaatgtggtcttggctcactacaaccactgactcctgggttcaagcaattctcctgcctcagccccctgagtagctgggactacaggtgtgcaccaccatgtaaagcaaattcttgtatttttagtagaaatggggtttcaccatgttgggcaggctggtctcgaactcctggcctcaagtgatccgctggccttggcctcccaaagtgctagaattacatgcatgagccaccgtgcccagccttacatgagatgtttcgatacaggcatacaatgtgaaagaagcacatcatggggaatgggatatccatcccctgaagcatttatcctttcagctacaaacaatccaatgacattctttaagttcttttaaaatgtacaattaagaaatcccttggtcgggctcagtggctcacgtctgtaatcccagcactttgggaggccaaggctagcagatcacctgaggtcaggagttcaagaccatcctggcctacatgatgaaacctcgtctctactaaaaatacaaaaaaattagtcaggtgttgttgcacgcacttgttgtcccagctactcaggaggctgaggcagcagaattgcttgaacccaggaggcagaggttgcagtgagctgagatcatgccatgccactatagcctgggaaacttcatctcaaaaaaaaaaaaaaaaaagcaagaaatcccttgagggtcaatttctttactgatggcttgcaactggcctaaccacttgtgaagtcagtatggcttcactatatttaggtggttcaattcatgcatcaatacgaaccctgggatcttgcacaagggtctctctgtatcccaatgctggcctgcgcacacactttttctctctcttgctgtgctgtgtccttcagtgttaaataaaagctgtaccacttcacacccactaggatggctacgattcacaaaatccagaaaatagcaggtgtcagccaggatgtagagaaatgggaatctttgtgcattgttggtgaaaatgctcaatggtgcagcccctgtgcaaaacagtgtggtggtttctccaataattaaacacagagttagcataggatccagcaattccacttctgggtatatactcaaaagaattgaaagcagggtctcaaagagatacttgtaaacctatgtccgtaacactgtttttcactgtagccaagaggtggaagcaacccaagtgtctatcagcagaggaatggataaacgaagtgtggtccatccatacaatgagacattgttcagccctaacgaaggaaattctgacacgtgctgcaacgtagatcaaccttgaggacattatgctaagtaaaataagccaggctcaaaaagactaatactctatgagtccattcatgtgaagtctctagagtcatccaatgcatagagacaatggtgggcactgggcactgggggaagggaacatgaggagttagtgtttaatggggacagaatctcactgaggatattaaaaaagttctggagataggtggtggtgatggttgcataacagtgtgaatccacttaatgccactgaaccgtgcacttaaaaatggttaaaatggtgagttttatattatgtatatttgaccaaaataacagataggtagatacatagatgatagatacatcatacatgatagatagttcatagctgggtgatgatgatacacaaatacatagataaatgataggtgagacagatagatgataggtgatagatgatagatgacagatggctagatgataggtagatacatagatggtagatagatgatagacagaaaaatagacagatgataggtagatgataagtagatgataagtagatagatagataataggtagattatacacagatgatagatagatgggtagatagatgctacataggtagatagatagcctccaagacaatgggagaataaatgtctgttgtttaagccctgcagtctatggtgttctgttatagcagcttgaaatggactaagacacctcataagaagagatgaggacacagacacacacagagagacgactgtatgaggacaaagggagaacacagagtctacaagccaaggagagaggcctcaggaggaaccagccctgcccacaccttgatctcagacttccgacctccaggattgtaaggaaataaatttctgttgtttaagcccctcagtctacagtcctttgttatggcagctctagcaaaggcatataccttctccatcccctctcctctgataaataccaatatctcaagagaacttggaggcagctgttgaagagagctgagccacaatgttgaaagttattgggtccctgattcaggacttgaaagagcatcaccagccaaccagaaacac[142 bp omitted]tggtgaaacctcgtctctactaaaaatacaaaaaaattagctgggcatggtggcgggcgcctgtagtcccagctactcgggaggctgaggcaggagaatggcgtgaacctgggaggcggagcttgcagtgagctgagatcaccccactgcactccagcctgggcgacagagtgagactctgtctcaaaaaaaaaaaccaaaaaaaaaaaaaaaaacactgagatttggtgttcattcatcagcttaagcagcttatcatggccctaactaacaaagcatgttttacataacaggtactttgcccacagtcaagtgtatcaagatcaaatgatgatgtgctacacctttgctgtagatttcttatcaatacactctttccttgtgtcctctgagagtctacttcactgcagggctgctgctaccagctgctgtggtcatagccttggtgttcttgtctaattaatgagggttcccattaaactagactccagctgttttgacttccagaattgctttaggagagtctctgtggtcattaataaggtgagaccttttggttcccaatacaaagagagaagataatttattttctacagcattttttcccataaagctctatattccgttacattttaaagggcatttcaacaaatgatgtatgaaatggagaacaaaatctgtatggttctgcagtaaagggcatgcaaaactagagaacggctctgaaatgatgtggaaaaacagcaatctacttttctttaaaaaaattaaaggcttatgcttcacataaattcatgtcgattttccaggcattatttggttataacgtctgaggcattgcatggatttactggtacctaaagtgtggatttattcttaagaagcatgcagctctacaatcttgtacagtgaaacgttgggcactcacaaagttatgcaagacaggttatgatgtgggcttaagaaaggtgttgagagctaggagtagagatatagaagaaaaaaagtgtaatattttcaagaaagagtaattagtttgtaagtggaggctactttcattgtttttttttttttaattttgatgttttagtgttatgttttttgagacagagtccagctctgttgcccaggatggagtgcagtggtgtgagcatagctcactgctgtcttgaacttccaggctcaagtgatcctcccacctcagtttcctgaatagctaggaccacaggcatgcaccatcatgcctggctaatttttaaatattttgtagaaactgggtctccctttgttatccaggctggtctccaactcctgggctcaagtgatcctcctcccttggcttcccaaagtgttgagattacgggcatgagccactgtgccaggccaacattgtttttaatatatgacttgtaaggcaagttggggggcattaattccttattaagatgtactgagttgaataaaagcccctccaaccatcaaccccccaaaatatatgtccaagtactaagctccagaatttgtgaatgcaaactaatttggataaagagtatttgcatgtaattaaggaaagattcttgagattagatcactataaattacccaggtggcctttaaatccaatgaccagtgtccttctaagagacagaagaggagacacagacacagaggaaaaggtcacgtggagatggaggcagagaatgtagtgatgtggccacaagcccagggacacctggagccaccaggagctggaagaggcaggaaggatcctctcctagaacctccagggggagcgcacccctgcccacaccttgatctcagattcctggtctccaatactggaaaagagtaaacatctgttactttacaccatccaagtttttgttatttgctacggcatccataggaattaaaaacctataggtatgaattttatgttgctgtcaaaaggcttcttctaggataagtagatatttcacctagatagttgtagctttttctcctcttcattgggatcggaactcagttggtgtcctccatcctcctatctcaatattgattttacttactctttaatcctaacaatgagcctttttatattgcttaattaaatatcaatgtctttctggtcaacatgagaccaaaaacctttttaccttgggcctgagaaagagcagtatttctcctcctcctcttcctcttcttcctcctccttccttcttctccctctttttagagatggggtctctctctgttgcccaggctagagtgcagtggcataatcctagctcactgcagcctcaaactcctgggctcaagtgatcttccagcctcagcctgctgagtaactgggaccacacatgtgcaccactatgccctatttttttgtttttttaacttatttatagaaatgaggtctcactatgttgcccaggctggtctcatacttctggcctcaagtgttcctcctctttggcctcccaaagcactgggattacaggtgtgagccaccatgctttggcatggtggggtatgcagtaggagagcaggggtggtggtagtgtctccatatgtactctcactaaaactggtgtgggcagatactggatgcctacttatttaggggcatctaaattcctgtgctaaattagaaaatagaggcagctcttgaaaggagtgatggcatgaaggagagatgcttggaccaaccaccacacaacccttataaataattgataaccttggttttgatgccacgtcctcttcaacagttgttggttgaaatgacacatgattccaggtgagcttttccagataaattgccctggaacttcagactttgtcgggtgaatcgatgtggaatttcagaatgggctggaatgtctaagatgggcatgtccaatattcagctcagtgtggggaaactggtggtggccagggctggttgcaagctgagttgtaggggtgacagttcacctgagaaacaaaaaaacatgcaagtcctggttcatgaggagtgatttcacaaatagtgaccatggaagtcaatgttgaaaaaacaaatagattcagagcataagggtgcaggtttgttacatggatatgttgcctagtggtggggattggccttctgtcccctaaacagtgaacataataccagataggtaatttttcaaccctcatcctctcccaccttcccccttttaaaggtgtccagtgcctgttattccattctataggtccatgtgtacccatttttagctcccacttataagtgaaaacatgtggtatttgattttctgtttctgagttatctcacttaggatattgacctgcagctccatttatgttgctgcaaaagatacagtttcattcttttttatagatgcatagtattccttggtgtgtgtataccacattttcttcatccaatgaacattcaggttcattccacgattttgctattgtgaattgaggtgcaataaaaatgtaagcataggcatcttttttgataatttcttttcctttgcatagataatcattagtggagttgctgggtcaaagggcagatctatttttagttctttgggaaatctacatactgtttcctatagaggttgtacaatttacttctcaccaacagtgtataagcattcccttgtctctgtactcttgccaacatgcgtctgttgtttttggaagtcagtgtttttctacaagaccttcatattggctataaataaaagtgataccttggaagagagtctatttctggacagccagagagggaaatgggaatgatcaggaaacataccgggattataagagagcttcattattttggtctggcttgagtccgtaaatggagtagcctcttagcggaacaaaatttcctccaattataatggtagttgccagaggcaacaacagtgaaagagccatttaaaaagtcaaaaccagaggaatcatttgactagaaccttcaatggctttgagtcactatgccagacagctcaattatcttatctctgccgtgaaaagctgtctttttcttgtacttacatctcttgagcagaatctcacataaaacatgccctaattacatggtccctattagatactacaccagggagtgcttggctttgatggtgcccagattgtctgaagtctgcagaaatccactgcaggcagaggcatttgggtggaccatgttcccaagattatcactttgtaaaatatggctcttgggagggcaaatttgcatgtagggtattctgaggaacaagtgtcgtactgccatcctaagggtcccttatggcaatgcctgagttatgtgtaattacaacagccatgggtctagagcttaagcctcctgcttccatggaaccaatgcattcaaaggttgaaggcacctttgagattttctaggctggctaccaagtcctatgtaggagaaagatgaagtctaacaaagccaggtgattttcagccacacaatgtgtaccttgatctagggtcaggttattcagcctcctactacaccaaattttagaatacaatttttattaggtgggatttaattaatgtcactgatgtataaaagtaaaaagaacatgttacagatgtaagatatatagattatatatttatctgtatacataagagaaatagatggacggatggatagatagacagatggataactagaagatagaaaattacacacatacattcataaatacatatatacatagatggatagatagatgattgacagagagaacaatataggtaaatgtagatagacgatagatgatagaaagatagacaataggtagatagatgttagatggaatagatgacagattaatgataggtagatagaatagatagataatgaatagatgatagaaagatagacagatagacaataataggtaggtagatagatgatagatggaatagatagatagatggtggatagatatatggaatagacgatagattatagatggaatgaacggatagatagaatatagtaatagaatgcatctacctgaaaatacaagagagaagaaaaagagattgggagtttttccactctataactttggggcaaagaaaatagcattaatgaaaaagcaaagaacgggaaaataaaaagtttttatccagaaccacccttccagcaaaagaaaatgtagggcaagcaaaatattaagcatttcatactcacttgtgtaggccatgggaactattatgaaaaggtggatgttgcatgtttcagtatattttttgttttgttttgtttttgagatggactctcgctgtgttgcccaggctggagtgcaatggcgaggtctcagctcactgcaacctccgcctcctgggttcaagcaattctcctgtctcagcctcccgagtagctgagattacaggtgcatgccgccatgcctggctaattttttgtacttcagtaaagatggggtttcactgttttgcccaggctagtcttgaacccctgagctcaggcaatccacctgcgttggcctcccaaagtgctgagattacaggtgtgagccaccacgcccgacctcagtacacttttaatatacacagagctttgccacattttggagggttacctactattgcaatttctggatttttatttcattttttatgtttgtgtctctccattttagtttaatgtaatgcaattcaatagattttctcattaaaataaaatctcagcctctctccattgcataggatgaagcaggcatgatgtagggcaagctcactggctggattcagacccttgaaggaggccgggcgcggtggctcatgcctgtaatcccagcactttgggaggctgaggtgggcagatcacttgaggtcaggcatttgagaccagcctggccaacatggtgaaactctgtctctaccaaaaaacccccaaaaatgaaaatacaaaaattaactgagtgtggtggtgcgtgcctgtagtcccagctacttgggaggttgaggtgggagaatcccttgaacctgggaggtggaggttacagtgagccgggatcatgccactgcactccagactgtgtgacagagaccctgtctcaaaaaaaaaacaacacaaaacccaaaacagacccttgagaagtgagcattttgcagtattccatttgggagctggctattctgcttcctcctgacatcccaaaggacacaggatggcctgagctcccaggtaccctgggtttcccagtaagaattccaggagtgttgagagaaatgcaaattgtctctgcagagcagcagaccccagagcttaaaggcttctctccgttcacagattgccgcatggagatgagaggaaatagagggtgaacagatctcctgctactgcacatgctacttttgatttcccagctggtgtttgaaggctgtgcaaggtgttggtttgcaggatgatggagacccagatcattgtgaatccatgaccgtgtggccgtttgcatcgactcagccttactgcagatactaaccttcattcccctctccagctatgcactggttttctgcataccacttggaatttatgttggctctgagtcatctgactctcacatgagaaagaaccaaataatgacctgttattttaaaagaaagtatctgcatatggcttcttgtctgccgaatgttgcacattaggccttttttattgagtttcaaataaacccctgaattaattctgcaggcaaaggcattgatgttagcaccatttgatcgcttgaatgcacgtcataacagcattttaacgtgcttacagcaagggggatgagaccatatcgaggatgcactt[132 bp omitted]agtacctgttttaagcaaaaacagcaaggaagtaaaaccaaagacaggcagctcggtgccaggcctgaaaccaggcctgggcctgcctggcctacacccagtagttaaaaatcaactcatgacttagaaaccggtgttattcatagattccagacattgtatagaagaacactgtgaaactccctgccctgttctgtttctctctgaccaccggtgcatacagcccctgtcacgtaccccctgcttgctcaaatcaatcacgaccctttcatgtgaaatctttaatgttgtgaacccttaaaagggacagaaattgtgcactcggggagctcggattttaaggcagtagcttgccgatgctcccagctgaataaagcccttccttctacaactcggggtctgagaggttttgtctgcggctcatcctgctacaaggtgggtggatcacttgagtccaggagtttgagactagcctggccaacatggcgaaaccctgtctctacaaaaaatacaaaaattagccaggtgttgtgttgtgtacctgtagtcccatactcaagaggctaaggtgggtggatctctggagcctgggaagtcaaggctgcagtgagtggagatcatgccactgcactccagcctgggtgactgagcgagactctgtctcaaaaaaaaaaataaaaaaaaaaaaagaagaagaaaagacatgtacaatagattattgtaaactacagtcacttgctgatctattgaacactatgtcttttttctcttatcgaagtgtatatttgcaaagtgggaggatttcttgagctcaggagctcgagacctgcctgggcaacctagtgagaccctgtctctacaaaaaaaaacacaaaagccagcctggcatggtggcatgcacctgtagtcctagctactggggaggctgaggtaggaggattgcttgagcccaggagttcaaggttaccgtgagctatgatcgcaccactgtacttcagtctggcaacagagcagaatcctgtctccaaaaaaacaaaacaaaaaaccaaaaaaacctaagatatttgcatccattaatcaaactatttttatctcccttctctgctcccttcccagcctctggtagccaccaatctactctctatctccatgagatccaggttttaagctcccacatgtgagtgagaacatgcagtatttttcttctgtgcctggcttatttcacttaacataatgacctccagttccatccatcaggcctccttttttcacggaggatttattttaggaaacttgcaattgtgagttctttctctatctctttgagatgcaaatcttctcccaaattttcttctagcctcttcctagttttgcaacccaggaatgcctttctcaagacttcagagccatccctttaaaatgcaattattgaaggagatgatacatctgtgtctcagtttttgtagaagggcagattcctagttttgaaaaattccaatgagccaacgcagatagctttacagcatttcctaacctcttcctgatgtctccagttccttctcagcatctcaccccggcacttaaaaactctccagccttttgtttcaacaaagttaagctccttctctcttccgtattgcagtagtcctgactgagtccttccttgaaggtttaacttgtctggtgcaattttttctttgacaatgtccagatcaaatgatcccataaaaacatcgagtgtgattttagcctgagaagggggagggtgagaagatagattgggaggcagctgtgtaggcaggggacttggccactccctaaacctctcccagtctcacctgtaaatggagtgcataggcagcagtgcttctcccccaaggctggggcgatggaatcagttagactactgagggcatctggaagggcatctgtgtcagggttagtcctcagggtatggtggccaatgggtttcttttggttgactgttgacaatgcgtttgttgaatggcagcctgcactaggtgacgctgaagccacagaagacactgcagtgggaaaaccagcatgagccgctgcccccaaggaacctcgaagcccaggcagaggaccagccatcccagcctgcaggtaaagtgtgtcacctgtcaggtgggcttggggtgagtgggtgggggaagtgtgtgtgcaaagggggtgtgagtgtgtatgcgtgtgagcatgagtgatggctagtgtgactgcatgtcagggagtgtgaacaagcgtgcgagggtgtgtgtgcaagtgcgtatgcatatgagaatatgtgtctgtggatgagtgcatttgaaagtctgtgtgtgtgtgtgtgtggtcatgagggtaagttagtgactgcgcaggatgtgtgagtgtgcatggaacactcagtgtgtgtggcaagtgtgtaggcgtgtgaggacaggcagaagtgtgtcagtgtgatgggagtgtgaatgagtgtgcaaaaaggtgagtgaatgtgcatggaagtgtgtgtcaactatgaaggcatgtagtgtgtcagtgtgtgcagtgcaagcatgtgtgggaatgagtgcttgtgggtgtgtccatatccaacgggtatgtgtgaaagcatgtaaaagtgtgtgtagtgtgatggtgtgtggatgtatcagtgtgtataaatgagagcatgtaaatgtgtatgtatgagtgttgagtgagtgtgcatatgtgaggctgtgtgtgtgagtgtaaccatgagggtgtgaacgtgcttaagtgtgcatgtgacagtgcaagtgtaggggtgtgatgcatgtgtgggtttgccagtgtatgagtgtacatggtgtggatctgaatgtgcacagtgtaaagggcatgagtgcaagtgtgtgtgagtgtatgtgaatgagtggtagtgtgcatgcatgtgtgagtgcacgctcagaagcatggatgggtgcaagcctcccctactaactcctcctccttcctgagatcaaaaaagtatgtgttttctgtgtttcaaaaatgttttaaaattatgtactgtatttaatagctcttatgactacagtgtttttctctctgcttaaagcgcagcaggggctgggcgcagtggctcacacctgtaatcccagcactttgggaggccaaggcaagtggatcagttgagatcaggagttcaagaccagcctggacaacatggtgaaaccccatgtctactaaaaatacaaaaattagccgggcatggtagcgggtgcctgtgatcccagctactggggaggctgaggtgg[137 bp omitted]acagtgacactgaaatgagaattgtgtcagaaaaaccacaaacaataatgaaatggctcctatataacccatccccaaaaacccacgtaaagaagaaaacagggctgggtgtagtggttcatgcctataattccagcactttgggaggcccagaagggaggattgcttgagcctgggaaatcgaggccacagtgagctgtatttgcaccactgtacttcagcctgagagtcagagtgaaaccttgtctcaaaaacagaaagacgaaaagggtacctgaggtattaactctgatcatcagtgagtggaaagattctggtattctggtgctttccattttcttttagcttatcttcatttttgagttttctggaagagcatttattgctttttttctttttgagacggagtctccctctgtcgcccaggctggagtgcagtggtatgatcttggctcactgcaacctccacttcctgggttcaagcgattttcctgcctcagcctcctgagtagctgggactacaggtacatgccaccacgcccggctaattttttgtattttttttagtagagacagggtttcaccttgttagccaggaggatggtcttgatctcctgaccttgtgatccacctgccttggcctcccaaagtgctgcgattacaggcgtgagccaccgcgcccggtcgcatttattgctttaagaaaaaaaaatttcacttgatgggaagaagctaaaatgaggctgactaggaaaatatcattactaaaaacattctccttcattcatggactttttttttgagacagtctcgttctgtcgcatatgctggagtgcagtggtacaatctcagctcactgcaaccttcgcctcccaggttcaaatgaattcttgtgtctcagcctcctgaataactggaattagaggcatgtaccaccatgcccggctaatttttgtattagggttttgtcatgttggccaggctggtcttgaacccctgacctcaagtgatacatctgcctcagcctcccagagtgctgggattacaagtgtaagccactgcgcctggcccttgttttggctaactctgagggaaactctttctgccatgggagattgtaccttaccattgtttatttccagggtctcctgagaacacagaccagaattactgaggtaatcttggcacattttcttaaccattttatgcgactttcaaattccttatatgtagctgggaaaaaaggctttgctagatgatctttttcaacctttgtgaagataaagattaagaaaaaagtttaaacctgaggcaaggaaaacacagaagaaaacctaaacaaagtttcggttctcagcccctgagcagccactcagtggtgggcgtttccttcactccccagtgagcacctactgtgtgttccgtatggcgcagggcagggaggagcaggccaagaaacaaacaagccttggggtcggggccacagagggcacggtgagctctcaggacacggcgggaagggaaggcagaaaggtcctgggcacaggctgggctgtcagctccagaggggcgcactgaccctgcatccatggtaagtgtggggcacaggcagtctgggctgcagcctcagagtggagcagagcccggggtgtaagaggccggctggggcaagtgggcaccaggagagcccaggctggccattatttgtggctgcatttccatttccaaaaatgtatgattttttcagttaatggagaaaaagcactgacaaaattcaacacgctttcatgattaaaaacattcagcaaactaagaatagagaaaactacctcaacataataaaagtcatatatgaaaaagccacatcacactcaatggtgaaaactgaaagcttttcctctaaaattaggaacaagacaaggatgtctgcattcattacttctatgcaacacagtgctagaagttctaaccggcacacttaggcaagaaaaggaaataaaaggcatcaaaattgaaaagaaagaagtaaaattatctctatttgcagataggatcttataagtagaaatgcctaaagggcgtgtgtgcacacacacacgttagaactaataaatgaggccaggcatggtggcttgtgcctataatcccagcactttgggagtcagacgtgtgcagatcacttgaggtcaggagttcgagaccagcctcaccaacatggcaaaacctggcaaaaccccatctctacaaaaaaatacaaaaattagccaggcatggtggtgggcacctgtggtcccagctacttgggaggctgaggcacaagaatcacttgaaccctggaggcagaggttgcagtgagccaagattgtgccactgcactccagcctgggcgacagagcaagagagcgagactctgtctcttttttcttttttaaaaaagaattaaaaaaaaaacctaataaatgaaatcagcaatgtagtagcatacaaggtaaatacacaggccaggtgcggtggctcacacctgtaatcccagcactttgggaggccaaggtgaatggatcacttgaggtcaagagttcaagaccagcctggccaacgtggtgaaaccccgtttctgctaaaaatataaaaaaattactggtggtacgtgactgtagtcccagctactcgggaggttgaggcaggagaatcacttgaacctgggaggtggaggttgtagtgaactcagactgctccactgtactccagcctgggcgacagagtgagactggaaaaaaaaaaaaaaaagtcaatagacaaaaatcagctgcatttctaaatactaacaaacaatgaacagtctgaaaaggaactaaagaaaatgaaaattccacttaaaatctagcaatcctacttctggatatataccccaaaaaattgaaaggagggcctcaaggaggtaattgaacacccgtgttcacagcagcattattcataatagctaaaaggtggaagcaacccaagtgtccattgacagatgaatgaatgagcaaaatgtggtatgcacagtgaaattttactccgccttaaaggacactgagacactttctacaacatgaaccttgagaatactgtgctaggtgaaataagccagtcacagaaagacaaatattctgtgattccacttctgtgaagaaagcagcgtagtcaaaatcatagagacagaaagtggaatagtggctgccagggttggggaaaaagggaatggagagttggtgtttatggggacagttttagtccccccactgccccgcttaccccaacttgaagctcagagttttagttgtacaagatgaaaagagttctggagatgtgtgggggtgatggccgtacaacatcgtgaatgtatttagtgcccctgaaccacacacctacatatggctaagatggtaaatgttatgctatgtatattttactacaataaaatatgttggaaaaaaaattttgatgtgataatgcaaacttacagcgactcacacctgctttatcgggagtttcagaaggggcaggagggagaggacacgctaagcagccagaggctattgacacaccggaagcatccccagggactgcctttctcaacatcaccctctgtaatggcagcgtcagccaagagtgcactgccattggttttactgaccaaacctaaagaaacggctgcgttcccatcagatttgctcactaaatcatgccgacacacagacatgcatcttccagcctgttcggcagcagtgcagacaacatgaggggtctcagatcttccacaagaatgattctggttctgcctgagccttcgcctgagtccccatcaggcattgtaaaggtcaacttaaggatgatgggcaggcagaggcaggaataaggactgatatggttgaatctctcattgctttagcaccatccgcttggtgctgctctcatgatagctggttgtttaaaagtgtgtggcacctgccgggcgcggtg[131 bp omitted]tggcgggcgcctgtagtcccagctactcgggaggctgaggcaggagaatggcgtgaaaccaggaggcggagcttgcagtgagccgagatcgcgccactgtactccagcctaggctacagagcgagactccgtctccaaaaaaaaaaaaggaaaaaaaaaagtgtgcagcacctaccccggccccttgtccctgctgtggccacgtgacatgcctgctcccactctgccttcaccgtgactgattctgaagcatccccagaagctgagcagatgccagcaccatgcttcccgtacagcctgtggaactgtgagccaactaaacctcttttctttataaaatacctggtctcaagtatttctttataacagtgtgagaatggccgaaaacgacacccagatgcaaacattacccaggccaccgcgtgctgactctctcaccaagcaggagcgggcccctccctcacgcggagccgctggcacggacagcctcgggaaggtcaggctgagcgtcctttcctctgtgcacccccggagggtgctcccattggctttctcagatagcaccatctcagggtccagctggccatggcctggattaagtttaaaatgctgggccagtccccacttccctatatatgactttttacaagtctgacacttgaagcttttgggcctcagggagcagcttgataagtcaaagagcgcctgcctctccctctgatcttcttccacactgacttctgaatcatcatcagaatctggcagatgaccgtcggccaaatcatccctttttatgaactcagctttagctgtatacttggcaggtcgagatacctgtctcaacgtgtcttcacttttaacgatggttttagtttctcagtatgttttgtatgcaagttggaaataaataaacgtcctgaactggatgaaacatgttacagtcggcgaactggaggccaacgaaggggtcaacatggtgccctgtccatttggagccttgggagctgggactttctttgcagggaccacctagagggctggcagtggtctctgtacaaacccctgagcaggaggctgatgtaggaaacatgactgtggctcggttctcacgaggggctgtaccctgagcagctgggggctggtgacgtggagtcccaccaggcgggaattcccccggggcggctggctctgtcttgcagattggggctagactgtggccagtagggacgttggccgttcctgaccttttgtttctccagacgttaccttgacacaaatggcttctagttgctttcctacagaaagacaagaaagggaaaagaagcattgtgcttatcaacatgtctgcaattctgctctcatagtaaatccactactgacattttttctaaattacgtcttacatatacaatttatgtaacgtgtttgtattaactgtttttcagacctttctgaccagaaaccacagtgatacaggccgggcgcagtggctcacacctgtaatcccagcacttcgggaggccaaggtgggcagatcacttgaggtcaggagttcaagaccagccaggccaacatggtgaaaccccttctctactaaggatacaaaaattagcagggtgtggtggtgcacacctgtaatcccagctactttggaggctgaggcatgagaatcgcttgaacctgggaggacgaggttgcagtgagccaagatcgcgccactgcactccagcctgggtgacagagcgagactccatctcaaaaaacaaacaaaatggccgggcacggtggctcacgcctgtaatcccagcactgtgggaggctgaatcacttgaggccaggagttccagaccagcttggtcaacatggtgaaaccccatctatactaaaaatacaaaagttagccgggtgtggtggcacattcctgtactcccagctacttgggaggctgaggcaggagaattgtttgagcctgggaggcggagaggctgcagtgagccgagatcctgccactgcactccagcctgggtgacagagctagactcagtctcaaaaacaaacaaaaaacaaaaacagaccacagtgacacattttacattatgacctagtatgcacgtatataaatatttgcatacataaatgaaaagctgatggaactacttagcattcctatgtaaatgcctgctgattgtatctattcttcatttctacatcacctttttttttttttttttttttggagacggtctcactctgttgcccaggctggagtgcagtggcgcgatcttagctcatggcaacctccgcctcccaggttcgagtgattctcctgcttctgcctcctgtatagctgggattacaggcacacgccaccatgcctggctaatttttgtattttctgtagagacggggtttcaccatgttggacaggctggtgtcaaactcctgaactcaagtgacccgcccgcctcgacctcccaaagtgctgggattacaggtgtgagctaccgcactgaccctaatctacatcactttaaaaaaaatactagtcataatccactaagttgatttcatgatgaattaagagataataagagccttcttaacagtttcacccatgtgtttttgcttggagtttttagtactctaaaatcagatgtaattcataatgtgggaccatgtttttaaaaaagtttctaatgaaattctagaagccacaaaaaagccataaaggacaatgttacccaggatcctcctgcccaacctgcatgcccgtttcttcaccctgtcctgaatgtgctgttcagcattcttatgctttttaaatatttacatggcatatgcagatatttctaaaaatatacagttcagttctgaaatgctttaaaactttatagaaatgatatcatctcctgcaacttgatagggcttttttcaggtttctttactccattttgctttgtgaattttaccctcattgacatgtgtagctctcaggggttgattttctctgcagtatgagtttaccaatctcctattgatggatgggtactttccaaccttctgctctaaggtctgctctgaatctccacggatgtatgtgtgtacatgtgtgagtttctccaggggcatgtatctaggagtagggctgaatatctttttcttttttttttttttttttgagagaaggtcttgctctgttgtccaggctggagtgcaatggcatgatctcagctcactgcaacctgcgcttcccaggtacaagtgattctcctgcctcagcctcccgggtagctgggattacagacacgtgctactacgcctggttaatttttgtatttttagtagagatagggtttcaccatgttgtccaggctggtctcaaactcctgacctcaagtgatctgccccactcagcctctcgaagtgctggaattacaggcgtgagccaccgtgcccggccgggctgaatatcctcaacaactttttacaaatatatctaacaaaatttcaaatacatgtgctttttgacccagtaattctacttcctggattccaaaattaaaaaaacttagatggccataaagatgttatgttctatgaggttcaaggcagcactgtctgtaatagcaaaacacctaccaaaggggagagctaccttcgacaacatcccacaaatatttattgagtactgaccatgtgcatgagacactgctacaggtgtcagagaaacagttctcatacagcttaggggagaaggtcaggaagcaaaagaaacaaggctcctgccctcacagagcagaaataatgagcattttcctccagggagaaaaagaggcaaacctcgtcatccagagcatgatttcacaaccaacatttcagaacataatcctttgacatgggtggctggaggatgcccagcagcatctctgcctctacccactagatgctagtagtgatcccgagtcctgacaagatattgccaagtgccccttgtggggcaaaactgtcctcggttgagaaccacttatttgggaccaccaactggccctctttggactcaaccttctggtgtgaccctcaaacagtagaaagtcaataaaaatgtcaaacaggacagaataaagaccctcactgagatcaggctggagtgtgtctctcgtctggctcttgttatacactagtacaaataacagaggtcaagtgtaccgaggtggcaccacaaccctgggagtccccattcctgggctacgtgcaaatcaaatgacaactagattggctgtgcatatccttcaagaacgatgtctgtttcattttactaccaatcacacagaatctctctctaagggccaaacacaaatcacacctgcagtagcagtgctttgggatgctgaggtgggaggattgcttgaggccaggagttcagggccagcctgggcaacagagcaagaccctgtccctacaaaatgttaaaaaaaaacacaaaaacccaaaacaaagagtctcactgttgcctaggctggactgcagtggtgcattcttggctccctgaaacctctgcctcccgagttcaagcgattttcctgactt[131 bp omitted]ccgccgcctcccaaagtgctgggattccaggggtgagccaccgagccccgcctacaaaacattttaaaattaggcttgatggtacatgcctgtagccccagatactcgggaggctgagggggaaggatcgtttgagtctgggagtttgaggctgtagtgagccgtgatcagtccagcctgggtgagaatgcaacaccttgtctcaacaaaaccccaaaacaacaacaaaatacatatacacacagacacacaacctaaaccctattgttttaggataaccacagcagcaaagccggcctaataatgtattcatcctctatcctgactggcttaccccgtgggtattacgcctcatgctttcttgtgtgtttttattttgtttggtgaacatttactaaatatttctggatggaatacatacacactagccaactcctagcctcacccttgagatggtgggcagtttccctgccatgcctcagtccccgcagacctgctgaatcgatctcctgggtcggagacccgatctgccctttcaaaagctccgctgacgatttcgaaggcagacaagtttccctaaggaatgcagacaggtgaggcagacgggaaaaatgtcatcatggtacaacaggtgcaataaagaggcagaacagaccagaagcagtgatctctgaggggcgttttgaaggctgggaatttttgccaggtagggcattctgagtacaaagaaaaatgtgtacatgcatggatgcatgaaaaggggttggcatgttggatggaactggacatttctggggggtgggaagagggaagatgcggagagacaggggcctccatctgacccaagtgtgtccactggtctgtgcttctgatccacaccatcccccacagcgaaccactgggcagtctgctgtggttgttgaaatgcaccccgccacctgctccagaacctgcctctcctcttctgcattttcaactcagactcaccctttcaaatctagttcagacaccacttcttcaacaaagctgcttgtgatttcctcggccagaaacaatctccctttctctaactacatttagttcttcatcactagctttcaggccttgattagcaggtatctgggtcatgttttatctcctgttagttcatcagctactgaggggcaaagtacacatccggtttgacttcgtggcttccacgacacagctggggctgaaaaagtattcgcagaatgtgctacaaaggtacattattggaggtagaatttatacgtctccatcagattagctacagaataagtcccatcatgctgcctgatcttgactaagtttgcttttactttatgaaaagtatgtcattttttgactccattccaaacccaaaaagctgtggccacatacagcagggtgtgctggggagaacaagggctctggagagcagccacacctgagggatcttggacaaagccactcaacctccctgcaaaatgctggtacaaaaacactactgcgagctaagcaacccagaacactgcccggcacagagcagaggctcagcagatggctgtcccgggatggcgtcttgcagccttcggacccagaccacagtccaaaaaggtcgagttgcccaaggtcacacctctagatagtgtggcatttgggcagaatcatacttgccttcctaaaccttagcaagacaactctccactcttgatgatgaactggatacaacaaccccaggcagctaaaatcacgagtgaagtcgaaaaaactcaggagtgaagatcgctgattctattctctaacgcatctcttctagtggaaaaagccctcttcttttggcaattttgggttaagactaattttatttacagcgccagcaatgaaatgagatggaattttacagacgccgtgtaggacccctggaaggacaatgagagtacccaccccaaaagcatagtatctgtatgcaaaaacagtgacagagacagagagagagagagaaagaaaatgctgagaagcagcaatgaagagaagaaaatgctgggccgtggcacttgctgtgcctgagacctgaaaagctcagttggttccttttaattcattcaggtctcaggggcagcgtctggcctacgggcccacccactctaaagcggccccctgtccctcccagaacctgcctgatgttcgttcttcgagtgtgttgaaggccgcacctcctgcacttaggtgggagtgcgggcaaccccgtctctgagtgccccacagaggctgaacgagtggtcaaaggcgtgtcagacgagctaggcagcacaggggagccccgggcagggctgtggaggcagagagggcacgacggcgtcccaggcagagggcccagcgtgagcatcggctcctcaagtgaggctcctggggtgaaaacgccagggtggtggcaggtgggggccgaacgccgtccctaaggggctcagcttcgggacaccctgagtcttgactggggccggatactggccaccccggccaagcagctaaccccgccgcggggcctcggccccctccgggcctcagtttccccacgtcgctcccggagcctcacctggggcggcagcaggcgtggcgggcacgggggctcggcgccagggtcccgctggagggcggcctgatgggccgcggcggcagcagctgcgccttcgtcacccgcttcaggacctgccgcagctgctcggggcccagcggggccacacgtgcaacgctgccctggcccggagaagcctggccgccgcatccgccgcggcggctgaagcggggactccaacctgggtcgctgggcgacgacgtgcctcacctgggaaagcggcgggctacgagtgccccgcaggccaagacacctcggaaggcgacgctgcccggccgggacagccgccgcggcccctagggccgatcagcacagcggacccaccttattttctcattgcctgtcacggatgtgtttaacactcagatgtcacctcctccgggagctgtccccgatctcccaggcggaggtctttgaggttccaaagcccctgacccaaaagttatcacattctttgaggttccaaagcccctggcccacaagttatcacgttatccacgtgttctgacgtcatcgtgcaccccaatcagcggaggatcctgcctggatacgcggagtcctaggtccaccagcaaacgtttaggtttataaatctgagaggggacccaaagtttgaatttttaacaagagcgcttcccaacccccaaactgttcccatgtcaccctaccgtctctcccctcacccacccaggctgcgtgtaccttgaagggagagacgatatgttactcattcggtgcccattacaggccctgcccagaacgcacgctcaaggcgtgaaagatggatggatgcatagaaaccaataaatgaacgggtgaacaaatccacgaacccaccctctccacatgtccgtcccatccatccagccccagtgccccgtcttcctcagcccgatcgcctctcttacagggtcgaggctctgtgcaccctccccaccgagtcttgtagctgcaggtgtgtacacacgtcccagtcccagtcccagtcccagtccctctccccagggagcgtaggaggtccactggccaacaaacacttattaagcgcctggtgggtgagtcgccattccctccctgtggggtaccacgggtctagctggcgagaaggaggaaaccagcatttgcagtacagtatgatgagcaccatgaagccaggaaaggtaaggctgggggggggggggggggcgccaggctggtgtcagagaaggttctggaacatcaccatcatcctcatcaatacttcgcattcacgatgctccctgctattttttaatggtgaatttcatatgatgggtatcttaccacatttttttttgtttgtttgtttttagacagggtctcactctgttgcccaggctggagtgcagtggcgccatctcagctcgctacaacctcgacttcccgggctcaggtgatccttccacctcagcctctggagtagctcggactacaggcatgcgctaccatgcccagctaattttcgtttcttttttttttttttttttttaatagagagaggatctcaccatggtgcccgggctggtctccaactcctgggctcagatgatccacttgcctaggcctcccaaagtgctggaattacaggcgtgaaccactgcgcctggcccaagtcaatctttcctagttccttcccaagaagggatttatgacaactgagttcttttgagatcttttgggaagctctgcttttcagcagacaagaaatttcaggaattcaaatgccttctgctcaaaataattttcacgccaccgtggcacattctaaaccccttcaagttcaggaaacttgagggcagcagcctccaccgactcctccgtgctctgtccctgcatctaacccggcacgactactgcaagatgtgacatccaacttgttgcgtacaggtttctattgcaggtgtcagccgacccaggctctcctaacgttgcttatagtagcagcagcgccaccagccggcgtttattgagaactttcactacaccctgggcacttaccaaggttttaagccagtagtctgtagattttgagcagctactgatttaggtcagagttagtagatgtttccactggagagttttcaaaagcaggtggagcccctgctggatcgtgacagaaaatggcactgaccctacacaactggcttcgttcaacggagcacacctgaccaccccagaaacttgaaccaccagcgagaaactcatccacttgctctggctgcaaaatgcagaaccaagaggaagaaatgtgaagcctaagatgtctctgaaaagaaacggggggtgggggggaagagcaagagaaggtttccagaggcttccacaaccagaacgcctctctaaaaacatggcaggcatctactggctggtcactttctccacgtggcttgggatttgtgtctcacttaccgctttgctccccgcctagaacggtgctgggcatgcagtagccctacacaccatctgtggaatgcattcattgcagacctggattttcaaccctaagacttccccgcaaggcggccaagggaacacgaggcggtgacatctgggagcacccgtcttcactgggcgattcctccaggggagccacagcctcaggaagcgcgggggcggcaggggtgggggctgagggccggagatgtggatcgctttggatatcctgagtggcctgcaggtggcggagggtgcagggactcgggtgcggagccaccgccccagcgcatgcctggtacctcccgctctccccagcaggctgccctcgacaacctctgggcggggagaccaagagatcctgcagttcgctcctacccgcacgccgctcacagtacccgaaaggcgcatttttcacaaactgttgtagaaagagttcatggcggggtggcggcggggaaaaaaaaaaaaaaaagctaacgccgtggccggtgcgggagtcgagcccgcgaccttggtgttatcagcaccacgctcttaccaactgagctaaccggccgcccgacggcacagtgcccctggagcgtataaaagggctccacgttcgcgcccgtccacgagcgattcctcgccaagcccgcgcgcctctggctgccttccgctttgccccagccgcggggactccggggaggagccaccgccccagcgctggccgggtttctcccgctcctccctgccaggctgtcctcgacaacctctgggccgagtccaagagatcccgcaagtcgctcctgcccgcatggggcttacagaacctgaaaggcgcattttgaaaaagagttgcagaaacagttcatggggagaaaacaaagaaacaaaccaacaaaaaactgggactagggccggtgcggggatcaagcccgcgaccatggcggtatcagcaccacgcgctcaccaactgagataaccgaccgcccgaccatctagtgctgcccgagcgtctgaaagggctccgtgttcgcgccggcccgcgactgatttccttgcagagcccgcgccactggctgcctccccgcttggccccagctgcgacttctgaccgcctcactgtcatccccattgggtggatgcagaaactgagacctaggagacttcaaggagaagggaggcggcttcctacagggaaccgcaggcttccacagggaaaatgcaaattgcacatgggaggcttggctctgcagtgaggttttcaaacattcccattcaatgctggttttaactctgagaatcctgaggcctggcaacttcgtgtatcaagagcctttcagcatggttaaatctagctcagaaaacccagaaaaccaaaggccaaaagaaccaccgaattccctattgcccaaaaaataacggctgcaggggtctcgacttccttcttgtccatttttatttcctttcactgtacacatgtatttctatatatatacacggaatccttgcgccaggagtggtggctcttgcctttaatcccagcactccgggatgaataaataaatgaatggaatggaaagccttgcttgaaaaagtgtattctgtcttcctttttgcatttaatagtctgtcattaagtatatcccgaaataattgcaaatgtcattttcaatgattcattcaaaaaaaagaaaagaaaaaaaatgagacggggaaagacagaaatagagaaacacaaaatgatattgtttggccatgtccccactgaaatctcaacttgaattttatctcccagaattccctcgtggtgtgagagggacccaggggaagtacctgaatcatggtggccggtctttcctgtgctattctggtgatagtgaataagtctcatgagatctaatgggtttatcagggtttctgcttttgcttcctcctcattttctcttgctgccaccatggaagaagtgcttttcgccctccgccataattacgagacttcctcagcctgtggaactgtcagtcaaattaaagctccttttcttcccagtcttgggtatgtctgtatcagtggcataaaaacagactaatatagtaaattggtaccgggagtggggtattgctgaaaagatacccaacaatgtcacagcgactttggaattgggtaataggcagaggttggaacagtttggagggcttagaataaggcaggaaaatgtgggaatgtttgcaacttcctagagacttgttgaatggctttagccaaaacgctgatagcgattatgacaataaggtccaggctgaggtggtctcagatagacatgagcaacttcttgggaactggagcaaaggtgactcttattatgttttagcaaagagactggtggcattttgcctctgcccgagagatttgtggaactttgaacttgagagagatgacttagaatatctagcagaagaaatttctaagcagcaaatcattcaaaatgtgacttgggtgctgttgaaagcattctgttttaaaagggatacagagcataaaagtttgaaaatctgcagcctgatgatccagtagaaaagaaaaatccatttttggggggagaaattcaagccagctgcagaaatttgcataagtaggaaggagtctaatgtctccaggccatgtcacagaccttcacagcagcccctcccatcacaggcccaggagaaaaaagtggttttgtgggctgggcccagggtctctgtgctgtgtgcagcctagggacttggtaccctgggttccagctgctccatctgtgactgaaaggagccaacgtagagctcaggctgtggcttcagaggatggaagccccaagcctgggcagcttccatgtggtgttgagcctgcagatgcacagaagtcaagaattgaggtttgagcacctccgcctagatttcagaagatgtatggaaatgcctggatgtccaggcaaaagtctgtggcaggggtgaggccctcatggagaacctctgctagggcagtgcagaagggaaatgtggggttggagcccccacacagagtccctactggggcactgcctagtagagctgtgagaagagagctactgtcgtccaaaccccagaaaggtagatccaccaacagcatgcaccataggcctggaaacacaacagacactcaacgtcagcctgtgaaagcagcagggagggatgttgtaccctgcaaagccacaggcacagagctgcccaagaccataggaatccacctcttgcacctgatgtgagacctgtagtcaaaggagatcattttggagctttaagatctgactgccccactggattttggacttgcacgggccctataacccctttgttttggcctatttctcccatttggaatggctgtatttacccaatacctgtatccccattgtatctaagaagtaactagcttgcttttgattttacaggctcataggtggaagggacttgccttgtctgactgtggacatttgggttaatgctgaaatgagttaagactttggggggactgttgggaaggtacagttagttttgaaatgtgaggacatgagatttggaggggccggggtggaattatacggtttgactgtgtccccactgaaatgtcaacttgaattgtatctcccagaatacccacgtgttgtgggagggactcagggggaggtaactgcaatcataggggcgggtctttcccgtgctattctcatgatagtgaataagtctcacgagatctgatgggttttcaggggtttctgctgttgcttcctcctcattctctcttgctgccgtcatgtaagaagtaccttttgccctctgccatgattatgggacttacccagccatgtggaactgtaagtcaaattaaacctcctggccaggcatggtggcttacacctgtaatctcaacactttgggagggtgaggtgggtggatcacctgaggtcaggagttccagaccagcctggccaacatggtgaagccccgtctctactaacagtacaaaaattagccaggagttggggcacgcacctgtaatcccagctactcaggaggctgaggcaggagaattacttcaacccgggaggcagaggttgcagtgagcctagatcgcgccactgcacttcagcctgggcgacaggagcaagactccgtctcagaaaaaaaagaaattcaacctccttttcttctaagtctagggtatgtctttatcagcagcgtaaaaacgactaatacagagagtaatgcataaagacacagaaagagggagagagacaaaaagagaaagagagagagagagagagagaatgtaataggagaaagggagggacaggagaaaaagagagggccctcttcccactatccttccaaaatcagggtttcctcatgaccccttcctcaaggcctaggtgccaaaaaggtcactgaaggaagcacagtcccctcttcctcagcaggcctgaaggctcctgggctatggctgctggtcttcctaagccagaagctataaccctgagccattgggcttcccagcctagcttcctcctgtccaaaatgagaggacaaacaggagttagagagcctgagaagacctgtcccagcaacacacccccctaagaaggcacaggctgaccactgacaactgtttaaatccagcgcccacgttcggctgggatattctgacccactcagggctgccccataaaccagcgcgtggtccggatccaagcgcaccgagaactcgaaacctctctgtcaagctgcccattgggagttaagttcaaagaggacaaaggaaacgagataaagcgtccaatacaagaattacccatttcagacgcacaagacgaagagcacaggcggtgtcaggacatgttaggatccgtccccaactccgccgtcttcatccccacaaagccacggaacacctgtaccccggagcccagctgctcctgcagcccctggagaaatctgtacattccccgccgaggaccctgccgctgggcacactgggaggctggcctgagggaccccgcgcccgtgtccctggggccgctgcctgggagagcgcacgatttaccccaggcgaggtgacccacaggaagtttggtgacgtcggatggcccaggccccagagtgctgtgtgtgctgggggtggagggtggtccccgacaggagccgtcggcgttccagggaaggcacccggtcggtcgggggactcgccggggctggggggtgcgctctacttctccgagcgccccccagggagacccagggcgcaggggcagccccgcgctgggatcccgagccgcagcggcggggcagggccctccccaggaggcgggcacccggggccctttgtcctacgacagcgtcccggccgcgccgcgcgcccctgtgggccgagtccccgcgcgcactcactcacccacggtgaccagcgtgtcgaagtcttgaaggcggttggcaggcggctccggcgaccgcgactcggggctggggcagagctcgggcgcccagtccggggtctcctctgccacggccgcctgggccagcccgggcgccttcatggggacgcactcaggtccggggcgccgggccgggccggagcgctcggggagccgggcttccgcggatgcagcctcggagggcggcgcggcggcatcaacggaggctccccatgcgcgccatgcggcttgtggaggccatcctgcccacccggcccggagcccgcaagacgccaatgcgccttccggtgcgcgcgcggccgggcgcggctgacggagcggcggggacaatggctggccgtcgctcacggcacaagcagcaacggccccaggtagcagcagccgccggcctcgtggggcgggcacggagcgccgggaggcggcggggaaggcgggggccgcggcccgggcttgtagagccaggcgggggccctgcgcattcccagtctcgcgcccgcggcctcctgcagctcggtagcagcgtgcgcgttgaagaggcgggcggaagccgcctgggcgaggcctaggggctgggggcgtcgccttcgcacgcgctccgcccctgccgcgacccagcccaggagccagagacctgggcgtgccccgccaccgtgggcaggcgcggccctggggaggtgctcacgccccctccgcgcccgaggcgcccctcgggtggcacccaggacgacctctcaccgcgacctaccgccccgaccctcttaggcgcagaggcgcacaggtccagacccggctactcaggagggaggaaacattttacaacctgttctctcttgtctttgaagcctgctagctaaaagcttcatctgcatagtaaaactttggtctccaccacctcttatcacaacccagacattcctttctgtgatcccaggtcttcagataaactcaaccagctgtcaaccagaaaatgtttaaattcacccacagcctggaaccccctttcctccaccccctcgcccccacccaccacttctacttgtctcttttctggaccaaaccaatgtatttctcaaatgtatttgattgctgtctcatgccttcctaaaatgtataaaaccaaactgcaccccaaccaccttgggcacatgttctcaggacctcctgagggctgtgtaatgggccatggtcagtcgtatttggctcagaataaatttcttcaaatattttacagagtttgactctttttgttgacaccttttcttagacagctactacaagatgttcttcagaaaatggacggcgcaaactgagaacaagtaagaggtggattcagaaagttaggagatccggtggaggagagaagtgtagttggtggccagggtgacagccattcaccaggttccatagacaaacagttcatgttggagatggggttcaagagatgctagacggagccgtccaggaagaaagagcaggaatgaatggacaaaaagtatgggagttagaaaaactgatgaatttaggggcacatggtaggccttttggagcactgggataaaatagtttcaggcactaagtaaattttatataaaaagaaggcagcccagtgcagtggctcatgcctgtaatctcagcaactccagaggctgagttgggaggatcacttgagctcaggagtttgaggctgcagtgagctataattgcaccactgcactccagccttctagcttgggtgacagaccctgtctccaaaaaataaaaaggcaattactaactccaggaaaaaggaaagaaagaaaacataatcattgtagtcactggttcatctttgaatatcattgcaatggtcattataatggaaacactgatgatttcttaaaccaaatattgtgacctaaatgtttacaagaatgtggtaggagggaaaggacatttgtgattggatggaaaggcaggcaggagagtgtcacagtctgaggggttcttctttcctgctgccccccaaaaacccagtgcactgagaacagcagatgttgcagcaaagagggaggttaataattgcagggacagctaattgagaagaataggagaggtttctcaaatctgtctccctaaaaagttggaaactatggtttttcatggtacttttgtgggcagaagcctggggaactgcaacaactgatagactatggatgaaatctcaggggtgtctaaaactgtctttctgcaggtgagttagttcccaggagagggtatctcaggaccaggtggcatctcttggtctgccaaaatgctaaatctgaaaaatatttcaaagaccattgtttaggttttacaatagtaatgttatctacaagagtagtttgggaagttatacatcttgtgatccctggttacatgactctggtgcagtgaacaacttacatgaaaacacactaagtgatggcaggtcattgattaactatgcctattctttagcaaagttcaagcccctacagtaattctaaccttgttttctgaatgtggctttaatctgcagtcaaggagtggggtcagtttccttgcctcagagtttaactctctctctctctcactctctctgtgtgtgtataaatatatatacacaattatttactatttatttatttatttattattttttgagacacaatattgctctgttgtccaggttggagtgcagtggtgtgatcttggctcactgcagcctcaacttcctgggctcaagcgatcctctcacctcagcctcctgagtagctgggactacaggtgcacaccaccatgcctggctaatttttgtaaatttttttttgagaaggggtttcactatgttcctgaggctgttctccaactcctgggctcaagcaatcctcctgcctcggtctcccaaggtgctgggtggcaccacacctggcttcaaattttaactataaactaacttcctcacgcagttatcttggctgccacactagaataagcaaaaacaaaacaatttagcctgtgaggtctgatggaagatggagtcagtcacgttagatttctcatatttgtttttcttttccttttttttttgatggagttttgctgttgttgcccaggctggagtgcaatggcgtgatctcagctcactgcaacctctgcctcctgggttcaagtgagtctcctgcctcagcctcccgagtagctgggattacaggcacccgccaccatgcctggctaatttttttttttttttaatagagacggagttgcaccatgttggctggctggttttgaactcctgacctcaagcgatctgcctacctcagcctcacaaagtgctaggattacaggcatgagccaccgcacccagccaagatttctcacatttcttataattctgcaatctcagtttcaagaccaaatccccaataaccataaggcgtaaaattgacaaatcttgaaactgtagtgtaagaatattacatagcaccatgattgtaaatatgaaaacaaacatttaaaagattgaaattgaatagaggctgggaatgggacattttgatacaaggaggtttttttttaagtactaactctttcatatttcctttacaataatctgcttaaactttaagaacatttggaaaagaaggtgtcacagatgttcccttccagtcagacacgtcttcacttctttggttttactcctcttctctggagagatcatggcagagcttggcaccgtatatatactcatggggcactgatggcagtggacatttgagtgaggcagtctttgttttttacttttggagggtgattgtgaagatgaaatgaaataacccacatggcaatgcccacaattcacaaggcacataaacagggtgtcaggaaatactagctcagcagagattctacattcatcttttccctgagaatgataatgagggatgtttagtactgaaatcagaaagaatcaaaacacaggtatatctacatattcttagatacagcagaaatgtgttagtttttctctgtcctggaacagaagcagatgcagagatgcaagtgttaaaaactgcatggtagaataaatactccatacacttggagtggccacatttagcaaataaaaattgtaataaatttaaatttcagataacacattttaaaatgttttaaattttaattatatttattctacttttttatttttattttttgagacagggtctcactctgtggcccaggctggagtacagtggtgtgattacggctcactgcagcctctacctcttcgggctcaggcgatccccacacctcagcctcctgagtagttggactacaggtgtgcaccatttcgctcagctaatttttgtatttttgtagagacagggtttcaccatgttgcctaggctggtcttgtactcctgggatcaacaatccccccacctcagcctcccaaagtcctaggattccaggtgtgagccactgcacttggccaagtaacagatttttgagtatcagtatgccccatgtcacactgggggcatatggatactaaaaaattattcagtatttatctgaaattcacatttaattggtgttgtgtcttttatctggaaaccttatagatggctgaatttgcagctgtcatgtcactgtttgtggcttaatgaaggaattcatttgccatttacaaaaattcagtacccagaaggagaaaggggatgctgtttggaagaacatgatgtcactgccaatgctgaattaacttggtggtctggaatacacaatctgtgagcatcagtctctgtttttgtttttgtttttgtttttgtatttgtttttgtttttgtttttgagatggagtcttgctcagtcatccaggctggagtgcagtggcatgatatctgttccctgcaacctctgcctcctgggttcaagtgattctcctgtctcagtctcccaagtagcttggactacaggtgcgcaccaccatgcccagataaattttgtatgtttagtagagatggggtttcaccatgttggccaggctgagccttcagagggagtgtggctcggaccgcaccttgatttcagacttctggtctctagaaatgtgagaatgcacatttattgagactcattcagtgtctcaatttatggaactttgttaaaacagacctaggaaaataatactcccaatcagaaggacagaacaaacaagtggaattgtcaacacaacacaaaattggaggtatgtaccttttttagcagtaattgtatattaacttgctcttccaaagtggtggtttggagaatggataaacccaagtgtcaaggatgaaaataatgatcaattgaactccatatggaatataaaccaatttcaccctctcaatataatatgggtaattatttactcttcatgttgatttaatatttgcttttatagaatgaaaaaatataggtacactcacaactaggggccctaatcaatgatcatttatcatgagcatttgattttcaacacattatgaattacatggtggtatagtcaatgcagctcacaatagtggctttgaatctgcattgcccctggccatatgaccttcaacatatattttgaggttgggggaacaggaggaatattttttacgaattttgtgtttgatccaatatggttgtttttgaaagggctgtgtgaccctctgtggaaataaaattgatttatagctgaactggacaagctctatctatctcttgcaactactagaggtctggtctttgacccacggtcagtgggttttatgagatgttgcttaaagtctcatactgggcttggtaattgtagaatagagtggttctttgctttgcatggtgggataagatttcttttttaaaatttttaattttaatttttaatctttgtagatacatagtaggtgtatgtatttatggggtacatgagttgtttttgttttttatgaaacagagtctggctccgtcaccgaggctggagtgcagtaatgtggtcttggctcactacaaccactgactcctgggttcaagcaattctcctgcctcagccccctgagtagctgggactacaggtgtgcaccaccatgtaaagcaaattcttgtatttttagtagaaatggggtttcaccatgttgggcaggctggtctcgaactcctggcctcaagtgatccgctggccttggcctcccaaagtgctagaattacatgcatgagccaccgtgcccagccttacatgagatgtttcgatacaggcatacaatgtgaaagaagcacatcatggggaatgggatatccatcccctgaagcatttatcctttcagctacaaacaatccaatgacattctttaagttcttttaaaatgtacaattaagaaatcccttggtcgggctcagtggctcacgtctgtaatcccagcactttgggaggccaaggctagcagatcacctgaggtcaggagttcaagaccatcctggcctacatgatgaaacctcgtctctactaaaaatacaaaaaaattagtcaggtgttgttgcacgcacttgttgtcccagctactcaggaggctgaggcagcagaattgcttgaacccaggaggcagaggttgcagtgagctgagatcatgccatgccactatagcctgggaaacttcatctcaaaaaaaaaaaaaaaaaagcaagaaatcccttgagggtcaatttctttactgatggcttgcaactggcctaaccacttgtgaagtcagtatggcttcactatatttaggtggttcaattcatgcatcaatacgaaccctgggatcttgcacaagggtctctctgtatcccaatgctggcctgcgcacacactttttctctctcttgctgtgctgtgtccttcagtgttaaataaaagctgtaccacttcacacccactaggatggctacgattcacaaaatccagaaaatagcaggtgtcagccaggatgtagagaaatgggaatctttgtgcattgttggtgaaaatgctcaatggtgcagcccctgtgcaaaacagtgtggtggtttctccaataattaaacacagagttagcataggatccagcaattccacttctgggtatatactcaaaagaattgaaagcagggtctcaaagagatacttgtaaacctatgtccgtaacactgtttttcactgtagccaagaggtggaagcaacccaagtgtctatcagcagaggaatggataaacgaagtgtggtccatccatacaatgagacattgttcagccctaacgaaggaaattctgacacgtgctgcaacgtagatcaaccttgaggacattatgctaagtaaaataagccaggctcaaaaagactaatactctatgagtccattcatgtgaagtctctagagtcatccaatgcatagagacaatggtgggcactgggcactgggggaagggaacatgaggagttagtgtttaatggggacagaatctcactgaggatattaaaaaagttctggagataggtggtggtgatggttgcataacagtgtgaatccacttaatgccactgaaccgtgcacttaaaaatggttaaaatggtgagttttatattatgtatatttgaccaaaataacagataggtagatacatagatgatagatacatcatacatgatagatagttcatagctgggtgatgatgatacacaaatacatagataaatgataggtgagacagatagatgataggtgatagatgatagatgacagatggctagatgataggtagatacatagatggtagatagatgatagacagaaaaatagacagatgataggtagatgataagtagatgataagtagatagatagataataggtagattatacacagatgatagatagatgggtagatagatgctacataggtagatagatagcctccaagacaatgggagaataaatgtctgttgtttaagccctgcagtctatggtgttctgttatagcagcttgaaatggactaagacacctcataagaagagatgaggacacagacacacacagagagacgactgtatgaggacaaagggagaacacagagtctacaagccaaggagagaggcctcaggaggaaccagccctgcccacaccttgatctcagacttccgacctccaggattgtaaggaaataaatttctgttgtttaagcccctcagtctacagtcctttgttatggcagctctagcaaaggcatataccttctccatcccctctcctctgataaataccaatatctcaagagaacttggaggcagctgttgaagagagctgagccacaatgttgaaagttattgggtccctgattcaggacttgaaagagcatcaccagccaaccagaaacac[142 bp omitted]tggtgaaacctcgtctctactaaaaatacaaaaaaattagctgggcatggtggcgggcgcctgtagtcccagctactcgggaggctgaggcaggagaatggcgtgaacctgggaggcggagcttgcagtgagctgagatcaccccactgcactccagcctgggcgacagagtgagactctgtctcaaaaaaaaaaaccaaaaaaaaaaaaaaaaacactgagatttggtgttcattcatcagcttaagcagcttatcatggccctaactaacaaagcatgttttacataacaggtactttgcccacagtcaagtgtatcaagatcaaatgatgatgtgctacacctttgctgtagatttcttatcaatacactctttccttgtgtcctctgagagtctacttcactgcagggctgctgctaccagctgctgtggtcatagccttggtgttcttgtctaattaatgagggttcccattaaactagactccagctgttttgacttccagaattgctttaggagagtctctgtggtcattaataaggtgagaccttttggttcccaatacaaagagagaagataatttattttctacagcattttttcccataaagctctatattccgttacattttaaagggcatttcaacaaatgatgtatgaaatggagaacaaaatctgtatggttctgcagtaaagggcatgcaaaactagagaacggctctgaaatgatgtggaaaaacagcaatctacttttctttaaaaaaattaaaggcttatgcttcacataaattcatgtcgattttccaggcattatttggttataacgtctgaggcattgcatggatttactggtacctaaagtgtggatttattcttaagaagcatgcagctctacaatcttgtacagtgaaacgttgggcactcacaaagttatgcaagacaggttatgatgtgggcttaagaaaggtgttgagagctaggagtagagatatagaagaaaaaaagtgtaatattttcaagaaagagtaattagtttgtaagtggaggctactttcagtgttttttttttttaattttgatgttttagtgttatgttttttgagacagagtccagctctgttgcccaggatggagtgcagtggtgtgagcatagctcactgctgtcttgaacttccaggctcaagtgatcctcccacctcagtttcctgaatagctaggaccacaggcatgcaccatcatgcctggctaatttttaaatattttgtagaaactgggtctccctttgttatccaggctggtctccaactcctgggctcaagtgatcctcctcccttggcttcccaaagtgttgagattacaggcatgagccactgtgccaggccaacattgtttttaatatatgacttgtaaggcaagttggggggcattaattccttattaagatgtactgagttgaataaaagcccctccaaccatcaaccccccaaaatatatgtccaagtactaagctccagaatttgtgaatgcaaactaatttggataaagagtatttgcatgtaattaaggaaagattcttgagattagatcactataaattacccaggtggcctttaaatccaatgaccagtgtccttctaagagacagaagaggagacacagacacagaggaaaaggtcacgtggagatggaggcagagaatgtagtgatgtggccacaagcccagggacacctggagccaccaggagctggaagaggcaggaaggatcctctcctagaacctccagggggagcgcacccctgcccacaccttgatctcagattcctggtctccaatactggaaaagagtaaacatctgttactttacaccatccaagtttttgttatttgctacggcatccataggaattaaaaacctataggtatgaattttatgttgctgtcaaaaggcttcttctaggataagtagatatttcacctagatagttgtagctttttctcctcttcattgggatcggaactcagttggtgtcctccatcctcctatctcaatattgattttacttactctttaatcctaacaatgagcctttttatattgcttaattaaatatcaatgtctttctggtcaacatgagaccaaaaacctttttaccttgggcctgagaaagagcagtatttctcctcctcctcttcctcttcttcctcctccttccttcttctccctctttttagagatggggtctctctctgttgcccaggctagagtgcagtggcataatcctagctcactgcagcctcaaactcctgggctcaagtgatcttccagcctcagcctgctgagtaactgggaccacacatgtgcaccactgtgccctatttttttgtttttttaacttatttatagaaatgaggtctcactatgttgcccaggctggtctcatacttctggcctcaagtgttcctcctctttggcctcccaaagcactgggattacaggtgtgagccaccatgctttggcatggtggggtatgcagtaggagagcaggggtggtggcagtgtctccatatgtactctcactaaaactggtgtgggcagatactggatgcctacttatttaggggcatctaaattcctgtgctaaattagaaaatagaggcagctcttgaaaggagtgatggcatgaaggagagatgcttggaccaaccaccacacaacccttataaataattgataaccttggttttgatgccacgtcctcttcgacagttgttggttgaaatgacacatgattccaggtgagcttttccagataaattgccctggaacttcagactttgtcgggtgaatcgatgtggaatttcagaatgggctggaatgtctaagatgggcatgtccaatattcagctcagtgtggggaaactggtggtggccagggctggttgcaagctgagttgtaggggtgacagttcacctgagaaacaaaaaaacatgcaagtcctggttcatgaggagtgatttcacaaatagtgaccatggaagtcaatgttgaaaaaacaaatagattcagggcataagggtgcaggtttgttacatggatatgttgcctagtggtggggattggccttctgtcccctaaacagtgaacataataccagataggtaatttttcaaccctcatcctctcccaccttcccccttttaaaggtgtccagtgcctgttattccattctataggtccatgtgtacccatttttagctcccacttataagtgaaaacatgtggtatttgattttctgtttctgagttatctcacttaggatattgacctgcagctccatttatgttgctgcaaaagatacagtttcattcttttttatagatgcatagtattccttggtgtgtgtataccacattttcttcatccaatgaacattcaggttcattccacgattttgctattgtgaattgaggtgcaataaaaatgtaagcataggcatcttttttgataatttcttttcctttgcatagataatcattagtggagttgctgggtcaaagggcagatctatttttagttctttgggaaatctacatactgtttcctatagaggttgtacaatttacttctcaccaacagtgtataagcattcccttgtctctgtactcttgccaacatgcgtctgttgtttttggaagtcagtgtttttctacaagaccttcatattggctataaataaaagtgataccttggaagagagtctatttctggacagccagagagggaaatgggaatgatcaggaaacataccgggattataagagagcttcattattttggtctggcttgagtccgtaaatggagtagcctcttagcggaacaaaatttcctccaattataatggtagttgccagaggcaacaacagtgaaagagccatttaaaaagtcaaaaccagaggaatcatttgactagaaccttcaatggctttgagtcactatgccagacagctcaattatcttatctctgccgtgaaaagctgtctttttcttgtacttacatctcttgagcagaatctcacataaaacatgccctaattacatggtccctattagatactacaccagggagtgcttggctttgatggtgcccagattgtctgaagtctgcagaaatccactgcaggcagaggcatttgggtggaccatgttcccaagattatcactttgtaaaatatggctcttgggagggcaaatttgcatgtagggtattctgaggaacaagtgtcgtactgccatcctaagggtcccttatggcaatgcctgagttatgtgtaattacaacagccatgggtctagagcttaagcctcctgcttccatggaaccaatgcattcaaaggttgaaggcacctttgagattttctaggctggctaccaagtcctatgtaggagaaagatgaagtctaacaaagccaggtgattttcagccacacaatgtgtaccttgatctagggtcaggttattcagcctcctactacaccaaattttagaatacaatttttattaggtgggatttaattaatgtcactgatgtataaaagtaaaaagaacatgttacagatgtaagatatatagattatatatttatctgtatacataagagaaatagatggacggatggatagatagacagatggataactagaagatagaaaattacacacatacattcataaatacatatatacatagatggatagatagatgattgacagagagaacaatataggtaaatgtagatagacgatagatgatagaaagatagacaataggtagatagatgttagatggaatagatgacagattaatgataggtagatagaatagatagataatgaatagatgatagaaagatagacagatagacaataataggtaggtagatagatgatagatggaatagatagatagatggtggatagatatatggaatagacgatagattatagatggaatgaacggatagatagaatatagtaatagaatgcatctacctgaaaatacaagagagaagaaaaagagattgggagtttttccactctataactttggggcaaagaaaatagcattaatgaaaaagcaaagaacgggaaaataaaaagtttttatccagaaccacccttccagcaaaagaaaatgtagggcaagcaaaatattaagcatttcatactcacttgtgtaggccacgggaactattatgaaaaggtggatgttgcatgtttcagtatattttttgttttgttttgtttttgagatggactctcgctgtgttgcccaggctggagtgcaatggcgaggtctcagctcactgcaacctccgcctcctgggttcaagcaattctcctgtctcagcctcccgagtagctgagattacaggtgcatgccgccatgcctggctaattttttgtacttcagtaaagatggggtttcactgttttgcccaggctagtcttgaacccctgagctcaggcaatccacctgcgttggcctcccaaagtgctgagattacaggtgtgagccaccacgcccgacctcagtacacttttaatatacacagagctttgccacattttggagggttacctactattgcaatttctggatttttatttcattttttatgtttgtgtctctccattttagtttaatgtaatgcaattcaatagattttctcattaaaataaaatctcagcctctctccattgcataggatgaagcaggcatgatgtagggcaagctcactggctggattcagacccttgaaggaggccgggcgcggtggctcatgcctgtaatcccagcactttgggaggctgaggtgggcagatcacttgaggtcaggcatttgagaccagcctggccaacatggtgaaactctgtctctaccaaaaaacccccaaaaatgaaaatacaaaaattaactgagtgtggtggtgcgtgcctgtagtcccagctacttgggaggttgaggtgggagaatcccttgaacctgggaggtggaggttacagtgagccgggatcatgccactgcactccagactgtgtgacagagaccctgtctcaaaaaaaaaacaacacaaaacccaaaacagacccttgagaagtgagcattttgcagtattccatttgggagctggctattctgcttcctcctgacatcccaaaggacacaggatggcctgagctcccaggtaccctgggtttcccagtaagaattccaggagtgttgagagaaatgcaaattgtctctgcagagcagcagaccccagagcttaaaggcttctctccgttcacagattgccgcatggagatgagaggaaatagagggtgaacagatctcctgctactgcacatgctacttttgatttcccagctggtgtttgaaggctgtgcaaggtgttggtttgcaggatgatggagacccagatcattgtgaatccatgaccgtgtggccgtttgcatcgactcagccttactgcagatactaaccttcattcccctctccagctatgcactggttttctgcataccacttggaatttatgttggctctgagtcatctgactctcacatgagaaagaaccaaataatgacctgttattttaaaagaaagtatctgcatatggcttcttgtctgccgaatgttgcacattaggccttttttattgagtttcaaataaacccctgaattaattctgcaggcaaaggcattgatgttagcaccatttgatcgcttgaatgcacgtcataacagcattttaacgtgcttacagcaagggggatgagaccatatcgaggatgcactt[132 bp omitted]agtacctgttttaagcaaaaacagcaaggaagtaaaaccaaagacaggcagctcggtgccaggcctgaaaccaggcctgggcctgcctggcctacacccagtagttaaaaatcaactcatgacttagaaaccggtgttattcatagattccagacattgtatagaagaacactgtgaaactccctgccctgttctgtttctctctgaccaccggtgcatacagcccctgtcacgtaccccctgcttgctcaaatcaatcacgaccctttcatgtgaaatctttaatgttgtgaacccttaaaagggacagaaattgtgcactcggggagctcggattttaaggcagtagcttgccgatgctcccagctgaataaagcccttccttctacaactcggggtctgagaggttttgtctgcggctcatcctgctacaaggtgggtggatcacttgagtccaggagtttgagactagcctggccaacatggcgaaaccctgtctctacaaaaaatacaaaaattagccaggtgttgtgttgtgtacctgtagtcccatactcaagaggctaaggtgggtggatctctggagcctgggaagtcaaggctgcagtgagtggagatcatgccactgcactccagcctgggtgactgagcgagactctgtctcaaaaaaaaaaaataaaaaaaaaaaaagaagaagaaaagacatgtacaatagattattgtaaactacagtcacttgctgatctattgaacactatgtcttttttctcttatcgaagtgtatatttgcaaagtgggaggatttcttgagctcaggagctcgagacctgcctgggcaacctagtgagaccctgtctctacaaaaaaaaaacacaaaagccagcctggcatggtggcatgcacctgtagtcctagctactggggaggctgaggtaggaggattgcttgagcccaggagttcaaggttaccgtgagctatgatcgcaccactgtacttcagtctggcaacagagcagaatcctgtctccaaaaaaacaaaacaaaaaaccaaaaaaacctaagatatttgcatccattaatcaaactatttttatctcccttctctgctcccttcccagcctctggtagccaccaatctactctctatctccatgagatccaggttttaagctcccacatgtgagtgagaacatgcagtatttttcttctgtgcctggcttatttcacttaacataatgacctccagttccatccatcaggcctccttttttcacggaggatttattttaggaaacttgcaattgtgagttctttctctatctctttgagatgcaaatcttctcccaaattttcttctagcctcttcctagttttgcaacccaggaatgcctttctcaagacttcagagccatccctttaaaatgcaattattgaaggagatgatacatctgtgtctcagtttttgtagaagggcagattcctagttttgaaaaattccaatgagccaacgcagatagctttacagcatttcctaacctcttcctgatgtctccagttccttctcagcatctcaccccggcacttaaaaactctccagccttttgtttcaacaaagttaagctccttctctcttccgtgttgcagtagtcctgactgagtccttccttgaaggtttaacttgtctggtgcaattttttctttgacaatgtccagatcaaatgatcccataaaaacatcgagtgtgattttagcctgagaagggggagggtgagaagatagattgggaggcagctgtgtaggcaggggacttggccactccctaaacctctcccagtctcacctgtaaatggagtgcataggcagcagtgcttctcccccaaggctggggcgatggaatcagttagactactgagggcatctggaagggcatctgtgtcagggttagtcctcagggtatggtggccaatgggtttcttttggttgactgttgacaatgcgtttgttgaatggcagcctgcactaggtgacgctgaagccacagaagacactgcagtgggaaaaccagcatgagccgctgcccccaaggaacctcgaagcccaggcagaggaccagccatcccagcctgcaggtaaagtgtgtcacctgtcaggtgggcttggggtgagtgggtgggggaagtgtgtgtgcaaagggggtgtgagtgtgtatgcgtgtgagcatgagtgatggctagtgtgactgcatgtcagggagtgtgaacaagcgtgcgagggtgtgtgtgcaagtgcgtatgcatatgagaatatgtgtctgtggatgagtgcatttgaaagtctgtgtgtgtgtgtgtgtggtcatgagggtaagttagtgactgcgcaggatgtgtgagtgtgcatggaacactcagtgtgtgtggcaagtgtgtaggcgtgtgaggacaggcagaagtgtgtcagtgtgatgggagtgtgaatgagtgtgcaaaaaggtgagtgaatgtgcatggaagtgtgtgtcaactatgaaggcatgtagtgtgtcagtgtgtgcagtgcaagcatgtgtgggaatgagtgcttgtgggtgtgtccatatccaacgggtatgtgtgaaagcatgtaaaagtgtgtgtagtgtgatggtgtgtggatgtatcagtgtgtataaatgagagcatgtaaatgtgtatgtatgagtgttgagtgagtgtgcatatgtgaggctgtgtgtgtgagtgtaaccatgagggtgtgaacgtgcttaagtgtgcatgtgacagtgcaagtgtaggggtgtgatgcatgtgtgggtttgccagtgtatgagtgtacatggtgtggatctgaatgtgcacagtgtaaagggcatgagtgcaagtgtgtgtgagtgtatgtgaatgagtggtagtgtgcatgcatgtgtgagtgcacgctcagaagcatggatgggtgcaagcctcccctactaactcctcctccttcctgagatcaaaaaagtatgtgttttctgtgtttcaaaaatgttttaaaattatgtactgtatttaatagctcttatgactacagtgtttttctctctgcttaaagcgcagcaggggctgggcgcagtggctcacacctgtaatcccagcactttgggaggccaaggcaagtggatcagttgagatcaggagttcaagaccagcctggacaacatggtgaaaccccatgtctactaaaaatacaaaaattagccgggcatggtagcgggtgcctgtgatcccagctactggggaggctgaggtgg[137 bp omitted]acagtgacactgaaatgagaattgtgtcagaaaaaccacaaacaataatgaaatggctcctatataacccatccccaaaaacccacgtaaagaagaaaacagggctgggtgtagtggttcatgcctataattccagcactttgggaggcccagaagggaggattgcttgagcctgggaaatcgaggccacagtgagctgtatttgcaccactgtacttcagcctgagagtcagagtgaaaccttgtctcaaaaacagaaagacgaaaagggtacctgaggtattaactctgatcatcagtgagtggaaagattctggtattctggtgctttccattttcttttagcttatcttcatttttgagttttctggaagagcatttattgctttttttctttttgagacggagtctccctctgtcgcccaggctggagtgcagtggtatgatcttggctcactgcaacctccacttcctgggttcaagcgattttcctgcctcagcctcctgagtagctgggactacaggtacatgccaccacgcccggctaattttttgtattttttttagtagagacagggtttcaccttgttagccaggaggatggtcttgatctcctgaccttgtgatccacctgccttggcctcccaaagtgctgcgattacaggcgtgagccaccgcgcccggtcgcatttattgctttaagaaaaaaaaatttcacttgatgggaagaagctaaaatgaggctgactaggaaaatatcattactaaaaacattctccttcattcatggactttttttttgagacagtctcgttctgtcgcatatgctggagtgcagtggtacaatctcagctcactgcaaccttcgcctcccaggttcaaatgaattcttgtgtctcagcctcctgaataactggaattagaggcatgtaccaccatgcccggctaatttttgtattagggttttgtcatgttggccaggctggtcttgaacccctgacctcaagtgatacatctgcctcagcctcccagagtgctgggattacaagtgtaagccactgcgcctggcccttgttttggctaactctgagggaaactctttctgccatgggagattgtaccttaccattgtttatttccagggtctcctgagaacacagaccagaattactgaggtaatcttggcacattttcttaaccattttatgcgactttcaaattccttatatgtagctgggaaaaaaggctttgctagatgatctttttcaacctttgtgaagataaagattaagaaaaaagtttaaacctgaggcaaggaaaacacagaagaaaacctaaacaaagtttcggttctcagcccctgagcagccactcagtggtgggcgtttccttcactccccagtgagcacctactgtgtgttccgtatggcgcagggcagggaggagcaggccaagaaacaaacaagccttggggtcggggccacagagggcacggtgagctctcaggacacggcgggaagggaaggcagaaaggtcctgggcacaggctgggctgtcagctccagaggggcgcactgaccctgcatccatggtaagtgtggggcacaggcagtctgggctgcagcctcagagcggagcagagcccggggtgtaagaggccggctggggcaagtgggcaccaggagagcccaggctggccattatttgtggctgcatttccatttccaaaaatgtatgatttttttcagttaatggagaaaaagcactgacaaaattcaacacgctttcatgattaaaaacattcagcaaactaagaatagagaaaactacctcaacataataaaagtcatatatgaaaaagccacatcacactcaatggtgaaaactgaaagcttttcctctaaaattaggaacaagacaaggatgtctgcattcattacttctatgcaacacagtgctagaagttctaaccggcacacttaggcaagaaaaggaaataaaaggcatcaaaattgaaaagaaagaagtaaaattatctctatttgcagataggatcttataagtagaaatgcctaaagggcgtgtgtgcacacacacacgttagaactaataaatgaggccaggcatggtggcttgtgcctataatcccagcactttgggagtcagacgtgtgcagatcacttgaggtcaggagttcgagaccagcctcaccaacatggcaaaacctggcaaaaccccatctctacaaaaaaatacaaaaattagccaggcatggtggtgggcacctgtggtcccagctacttgggaggctgaggcacaagaatcacttgaaccctggaggcagaggttgcagtgagccaagattgtgccactgcactccagcctgggcgacagagcaagagagcgagactctgtctcttttttcttttttaaaaaagaattaaaaaaaaaacctaataaatgaaatcagcaatgtagtagcatacaaggtaaatacacaggccaggtgcggtggctcacacctgtaatcccagcactttgggaggccaaggtgaatggatcacttgaggtcaagagttcaagaccagcctggccaacgtggtgaaaccccgtttctgctaaaaatataaaaaaattactggtggtacgtgactgtagtcccagctactcgggaggttgaggcaggagaatcacttgaacctgggaggtggaggttgtagtgaactcagactgctccactgtactccagcctgggcgacagagtgagactggaaaaaaaaaaaaaaaagtcaatagacaaaaatcagctgcatttctaaatactaacaaacaatgaacagtctgaaaaggaactaaagaaaatgaaaattccacttaaaatctagcaatcctacttctggatatataccccaaaaaattgaaaggagggcctcaaggaggtaattgaacacccgtgttcacagcagcattattcataatagctaaaaggtggaagcaacccaagtgtccattgacagatgaatgaatgagcaaaatgtggtatgcacagtgaaattttactccgccttaaaggacactgagacactttctacaacatgaaccttgagaatactgtgctaggtgaaataagccagtcacagaaagacaaatattctgtgattccacttctgtgaagaaagcagcgtagtcaaaatcatagagacagaaagtggaatagtggctgccagggttggggaaaaagggaatggagagttggtgtttatggggacagttttagtccccccactgccccgcttaccccaacttgaagctcagagttttagttgtacaagatgaaaagagttctggagatgtgtgggggtgatggccgtacaacatcgtgaatgtatttagtgcccctgaaccacacacctacatatggctaagatggtaaatgttatgctatgtatattttactacaataaaatatgttggaaaaaaaattttgatgtgataatgcaaacttacagcgactcacacctgctttatcgggagtttcagaaggggcaggagggagaggacacgctaagcagccagaggctattgacacaccggaagcatccccagggactgcctttctcaacatcaccctctgtaatggcagcgtcagccaagagtgcactgccattggttttactgaccaaacctaaagaaacggctgcgttcccatcagatttgctcactaaatcatgccgacacacagacatgcatcttccagcctgttcggcagcagtgcagacaacatgaggggtctcagatcttccacaagaatgattctggttctgcctgagccttcgcctgagtccccatcaggcattgtaaaggtcaacttaaggatgatgggcaggcagaggcaggaataaggactgatatggttgaatctctcattgctttagcaccatccgcttggtgctgctctcatgatagctggttgtttaaaagtgtgtggcacctgccgggcgcggtg[131 bp omitted]tggcgggcgcctgtagtcccagctactcgggaggctgaggcaggagaatggcgtgaaaccaggaggcggagcttgcagtgagccgagatcgcgccactgtactccagcctaggctacagagcgagactccgtctccaaaaaaaaaaaggaaaaaaaaaagtgtgcagcacctaccccggccccttgtccctgctgtggccacgtgacatgcctgctcccactctgccttcaccgtgactgattctgaagcatccccagaagctgagcagatgccagcaccatgcttcccgtacagcctgtggaactgtgagccaactaaacctcttttctttataaaatacctggtctcaagtatttctttataacagtgtgagaatggccgaaaacgacacccagatgcaaacattacccaggccaccgcgtgctgactctctcaccaagcaggagcgggcccctccctcacgcggagccgctggcacggacagccccgggaaggtcaggctgagcgtcctttcctctgtgcacccacggagggtgctcccattggctttctcagatagcaccatctcagggtccagctggccatggcctggattaagtttaaaatgctgggccagtccccacttccctatatatgactttttacaagtctgacacttgaagcttttgggcctcagggagcagcttgataagtcaaagagcgcctgcctctccctctgatgttcttccacactgagttctgaatcatcatcagaatctggcagatgaccgtcggccaaatcatccctttttatgaactcagctttagctgtatacttggcaggtcgagatacctgtctcaacgtgtcttcacttttaacgatggttttagtttctcagtatgttttgtatgcaagttggaaataaataaacgtcctgaactggatgaaacatgttacagtcggcgaactggaggccaacgaaggggtcaacatggtgccctgtccatttggagccttgggagctgggactctctttgcagggaccacctagagggctggcagtggtctctgtacaaacccctgagcaggaggctgatgtaggaaacatgactgtggctcggttctcacgaggggctgtaccctgagcagctgggggctggtgacgtggagtcccaccaggcgggaattcccccggggcggctggctctgtcttgcagattggggctggactgtggccagtagggacgttggccgttcctgaccttttgtttctccagacgttaccttgacacaaatggcttctagttgctttcctacagaaagacaagaaagggaaaagaagcattgtgcttatcaacatgtctgcaattctgctctcatagtaaatccactactgacattttttctaaattacgtcttacatatacaatttatgtaacgtgtttgtattaactgtttttcagacctttctgaccagaaaccacagtgatacaggccgggcgcagtggctcacacctgtaatcccagcacttcgggaggccaaggtgggcagatcacttgaggtcaggagttcaagaccagccaggccaacatggtgaaaccccttctctactaaggatacaaaaattagcagggtgtggtggtgcacacctgtaatcccagctactttggaggctgaggcatgagaatcgcttgaacctgggaggacgaggttgcagtgagccaagatcgcgccactgcactccagcctgggtgacagagcgagactccatctcaaaaaacaaacaaaatggccgggcacggtggctcacgcctgtaatcccagcactgtgggaggctgaatcacttgaggccaggagttccagaccagcttggtcaacatggtgaaaccccatctatactaaaaatacaaaagttagccgggtgtggtggcacattcctgtactcccagctacttgggaggctgaggcaggagaattgtttgagcctgggaggcggagaggctgcagtgagccgagatcctgccactgcactccagcctgggtgacagagctagactcagtctcaaaaacaaacaaaaaacaaaaacagaccacagtgacacattttacattatgacctagtatgcacgtatataaatatttgcatacataaatgaaaagctgatggaactacttagcattcctatgtaaatgcctgctgattgtatctattcttcatttctacatcacctttttttttttttttttttttttttttggagacggtctcactctgttgcccaggctggagtgcagtggcgcgatcttagctcatggcaacctccgcctcccaggttcgagtgattctcctgcttctgcctcctgtatagctgggattacaggcacacgccaccatgcctggctaatttttgtattttctgtagagacggggtttcaccatgttggacaggctggtgtcaaactcctgaactcaagtgacccgcccgcctcgacctcccaaagtgctgggattacaggtgtgagctaccgcactgaccctaatctacatcactttaaaaaaaatactagtcataatccactaagttgatttcatgatgaattaagagataataagagccttctcaacagtttcacccatgtgtttttgcttggagtttttagtactctaaaatcagatgtaattcataatgtgggaccatgtttttaaaaaagtttctaatgaaattctagaagccacaaaaaagccataaaggacaatgttacccaggatcctcctgcccaacctgcatgcccgtttcttcaccctgtcctgaatgtgctgttcagcattcttatgctttttaaatatttacatggcatatgcagatatttctaaaaacatacagttcagttctgaaatgctttaaaactttatagaaatgatatcatctcctgcaacttgatagggcttttttcaggtttctttactccattttgctttgtgaattttaccctcattgacatgtgtagctctcaggggttgattttctctgcagtatgagtttaccaatctcctattgatggatgggtactttccaaccttctgctctaaggtctgctctgaatctccacggatgtatgtgtgtacatgtgtgagtttctccaggggcatgtatctaggagtagggctgaatatctttttcttttttttttttttttttgagagaaggtcttgctctgttgtccaggctggagtgcaatggcatgatctcagctcactgcaacctgcgcttcccaggtacaagtgattctcctgcctcagcctcccgggtagctgggattacagacacgtgctactacgcctggttaatttttgtatttttagtagagatagggtttcaccatgttgtccaggctggtctcaaactcctgacctcaagtgatctgccccactcagcctctcgaagtgctggaattacaggcgtgagccaccgtgcccggccgggctgaatatcctcaacaactttttacaaatatatctaacaaaatttcaaatacatgtgctttttgacccagtaattctacttcctggattccaaaattaaaaaaacttagatggccataaagatgttatgttctatgaggttcaaggcagcactgtctgtaatagcaaaacacctaccaaaggggagagctaccttcgacaacatcccacaaatatttattgagtactgaccatgtgcatgagacactgctacaggtgtcagagaaacagttctcatacagcttaggggagaaggtcaggaagcaaaagaaacaaggctcctgccctcacagagcagaaataatgagcattttcctccagggagaaaaagaggcaaacctcgtcatccagagcatgatttcacaaccaacatttcagaacataatcctttgacatgggtggctggaggatgcccagcagcatctctgcctctacccactagatgctagtagtgatcccgagtcctgacaagatattgccaagtgccccttgtggggcaaaactgtcctcggttgagaaccacttatttgggaccaccaactggccctctttggactcaaccttctggtgtgaccctcaaacagtagaaagtcaataaaaatgtcaaacaggacagaataaagaccctcactgagatcaggctggagtgtgtctctcgtctggctcttgttatacactagtacaaataacagaggtcaagtgtaccgaggtggcaccacaaccctgggagtccccattcctgggctacgtgcaaatcaaatgacaactagattggctgtgcatatccttcaagaacgatgtctgtttcattttactaccaatcacacagaatctctctctaagggccaaacacaaatcacacctgcagtagcagtgctttgggatgctgaggtgggaggattgcttgaggccaggagttcagggccagcctgggcaacagagcaagaccctgtccctacaaaatgttaaaaaaaaacacaaaaacccaaaacaaagagtctcactgttgcctaggctggactgcagtggtgcattcttggctccctgaaacctctgcctcccgagttcaagcgattttcctgactt[131 bp omitted]ccgccgcctcccaaagtgctgggattccaggggtgagccaccgagccccgcctacaaaacattttaaaattaggcttgatggtacatgcctgtagccccagatactcgggaggctgagggggaaggatcgtttgagtctgggagtttgaggctgtagtgagccgtgatcagtccagcctgggtgagaatgcaacaccttgtctcaacaaaaccccaaaacaacaacaaaatacatatacacacagacacacaacctaaaccctattgttttaggataaccacagcagcaaagccggcctaataatgtattcatcctctatcctgactggcttaccccgtgggtattacgcctcatgctttcttgtgtgtttttattttgtttggtgaacatttactaaatatttctggatggaatacatacacactagccaactcctagcctcacccttgagatggtgggcagtttccctgccatgcctcagtccccgcagacctgctgaatcgatctcctgggtcggagacccgatctgccctttcaaaagctccgctgacgatttcgaaggcagacaagtttccctaaggaatgcagacaggtgaggcagacgggaaaaatgtcatcatggtacaacaggtgcaataaagaggcagaacagaccagaagcagtgatctctgaggggcgttttgaaggctgggaatttttgccaggtagggcattctgagtacaaagaaaaatgtgtacatgcatggatgcatgaaaaggggttggcatgttggatggaactggacatttctggggggtgggaagagggaagatgcggagagacaggggcctccatctgacccaagtgtgtccactggtctgtgcttctgatccacaccatcccccacagcgaaccactgggcagtctgctgtggttgttgaaatgcaccccgccacctgctccagaacctgcctctcctcttctgcattttcaactcagactcaccctttcaaatctagttcagataccacttcttcaacaaagctgcttgtgatttcctcggccagaaacaatctccctttctctaactacatttagttcttcatcactagctttcaggccttgattagcaggtatctgggtcatgttttatctcctgttagttcatcagctactgaggggcaaagtacacatccggtttgacttcgtggcttccacgacacagctggggctgaaaaagtattagcagaatgtgctacaaaggtacattattggaggtagaatttatacgtctccatcagattagctacagaataagtcccatcatgctgcctgatcttgactaagtttgcttttactttatgaaaagtatgtcattttttactccattccaaacccaaaaagctgtggccacatacagcagggtgtgctggggagaacaagggctctggagagcagccacacctgagggatcttggacaaagccactcaacctccctgcaaaatgctggtacaaaaacactactgcgagctaagcaacccagaacactgcccggcacagagcagaggctcagcagatggctgtcccgggatggcgtcttgcagccttcggacccagaccacagtccaaaaaggtcgagttgcccaaggtcacacctctagatagtgtggcatttgggcagaatcatacttgccttcctaaaccttagcaagacaactctccactcttgatgatgaactggatacaacaaccccaggcagctaaaatcacgagtgaagtcgaaaaaactcaggagtgaagatcgctgattctattctctaacgcatctcttctagtggaaaaagccctcttcttttggcaattttgggttaagactaattttatttacagcgccagcaatgaaatgagatggaattttacagacgccgtgtaggacccctggaaggacaatgagagtacccaccccaaaagcatagtatctgtatgcaaaaacagtgacagagacagagagagagagagaaagaaaatgctgagaagcagcaatgaagagaagaaaatgctgggccgtggcacttgctgtgcctgagacctgaaaagctcagttggttccttttaattcattcaggtctcaggggcagcgtctggcctacgggcccacccactctaaagcggccccctgtccctcccagaacctgcctgatgttcgttcttcgagtgtgttgaaggccgcacctcctgcacttaggtgggagtgcgggcaaccccgtctctgagtgccccacagaggctgaacgagtggtcaaaggcgtgtcagacgagctaggcagcacaggggagccccgggcagggctgtggaggcagagagggcacgacggcgtcccaggcagagggcccagcgtgagcatcggctcctcaagtgaggctcctggggtgaaaacgccagggtggtggcaggtgggggccgaacgccgtccctaaggggctcagcttcgggacaccctgagtcttgactggggccggatactggccaccccggccaagcagctaaccccgccgcggggcctcggccccctccgggcctcagtttccccacgtcgctcccggagcctcacctggggcggcagcaggcgtggcgggcacgggggctcggcgccagggtcccgctggagggcggcctgatgggccgcggcggcagcagctgcgccttcgtcacccgcttcaggacctgccgcagctgctcggggcccagcggggccacacgtgcaacgctgccctggcccggagaagcctggccgccgcatccgccgcggcggctgaagcggggactccaacctgggtcgctgggcgacgacgtgcctcacctgggaaagcggcgggctacgagtgccccgcaggccaagacacctcggaaggcgacgctgcccggccgggacagccgccgcggcccctagggccgatcagcacagcggacccaccttattttctcattgcctgtcacggatgtgtttaacactcagatgtcacctcctccgggagctgtccccgatctcccaggcggaggtctttgaggttccaaagcccctgacccaaaagttatcacattctttgaggttccaaagcccctggcccacaagttatcacgttatccacgtgttctgacgtcatcgtgcaccccaatcagcggaggatcctgcctggatacgcggagtcctaggtccaccagcaaacgtttaggtttataaatctgagaggggacccaaagtttgaatttttaacaagagcgcttcccaacccccaaactgttcccatgtcaccctaccgtctctcccctcacccacccaggctgcgtgtaccttgaagggagagacgatatgttactcattcggtgcccattacaggccctgcccagaacgcacgctcaaggcgtgaaagatggatggatgcatagaaaccaataaatgaacgggtgaacaaatccacgaacccaccctctccacatgtccgtcccatccatccagccccagtgccccgtcttcctcagcccgatcgcctctcttacagggtcgaggctctgtgcaccctccccaccgagtcttgtagctgcaggtgtgtacacacgtcccagtcccagtcccagtcccagtccctctccccagggagcgtaggaggtccactggccaacaaacacttattaagcgcctggtaggtgagtcgccattccctccctgtggggtaccacgggtctagctggcgagaaggaggaaaccagcatttgcagtacagtatgatgagcaccatgaagccaggaaaggtaaggctgggggggggggggggcgccaggctggtgtcagagaaggttctggaacatcaccatcatcctcatcaatacttcgcattcacgatgctccctgctattttttaatggtgaatttcatatgatgggtatcttaccacatttttttttgtttgtttgtttttagacagggtctcactctgttgcccaggctggagtgcagtggcgccatctcagctcgctacaacctcgacttcccgggctcaggtgatccttccacctcagcctctggagtagctcggactacaggcatgcgctaccatgcccagctaattttcgtttcttttttttttttttttttttaatagagagaggatctcaccatgttgcccgggctggtctccaactcctgggctcagatgatccacttgcctaggcctcccaaagtgctggaattacaggcgtgaaccactgcgcctggcccaagtcaatctttcctagttccttcccaagaagggatttatgacaactgagttcttttgagatcttttgggaagctctgcttttcagcagacaagaaatttcaggaattcaaatgccttctgctcaaaataattttcacgccaccgtggcacattctaaaccccttcaagttcaggaaacttgagggcagcagcctccaccgactcctccgtgctctgtccctgcatctaacccggcacgactactgcaagatgtgacatccaacttgttgcgtacaggtttctattgcaggtgtcagccgacccaggctctcctaacgttgcttatagtagcagcagcgccaccagccggcgtttattgagaactttcactacaccctgggcacttaccaaggttttaagccagtagtctgtagattttgagcagctactgatttaggtcagagttagtagatgtttccactggagagttttcaaaagcaggtggagcccctgctggatcgtgacagaaaatggcactgaccctacacaactggcttcgttcaacggagcacacctgaccaccccagaaacttgaaccaccagcgagaaactcatccacttgctctggctgcaaaatgcagaaccaagaggaagaaatgtgaagcctaagatgtctctgaaaagaaacggggggtgggggggaagagcaagagaaggtttccagaggcttccacaaccagaacgcctctctaaaaacatggcaggcatctactggctggtcactttctccacgtggcttgggatttgtgtctcacttaccgttttgctccccgcctagaacggtgctgggcatgcagtagccctacacaccatctgtggaatgcattcattgcagacctggattttcaaccctaagacttccccgcaaggcggccaagggaacacgaggcggtgacatctgggagcacccgtcttcactgggcgattcctccaggggagccacagcctcaggaagcgcgggggcggcaggggtgggggctgagggccggagatgtggatcgctttggatatcctgagtggcctgcaggtggcggagggtgcagggactcgggtgcggagccaccgccccagcgcatgcctggtacctcccgctctccccagcaggctgccctcgacaacctctgggcggggagaccaagagatcctgcagttcgctcctacccgcacgccgctcacagtacccgaaaggcgcatttttcacaaactgttgtagaaagagttcatggcggggtggcggcggggaaaaaaaaaaaaaaaagctaacgccgtggccggtgcgggagtcgagcccgcgaccttggtgttatcagcaccacgctcttaccaactgagctaaccggccgcccgacggcacagtgcccctggagcgtataaaagggctccacgttcgcgcccgtccacgagcgattcctcgccaagcccgcgcgcctctggctgccttccgctttgccccagccgcggggactccggggaggagccaccgccccagcgctggccgggtttctcccgctcctccctgccaggctgtcctcgacaacctctgggccgagtccaagagatcccgcaagtcgctcctgcccgcatggggcttacagaacctgaaaggcgcattttgaaaaagagttgcagaaacagttcatggggagaaaacaaagaaacaaaccaacaaaaaactgggactagggccggtgcggggatcaagcccgcgaccatggcggtatcagcaccacgcgctcaccaactgagataaccgaccgcccgaccatctagtgctgcccgagcgtctgaaagggctccgtgttcgcgccggcccgcgactgatttccttgcagagcccgcgccactggctgcctccccgcttggccccagctgcgacttctgaccgcctcactgtcatccccattgggtggatgcagaaactgagacctaggagacttcaaggagaagggaggcggcttcctacagggaaccgcaggcttccacagggaaaatgcaaattgcacatgggaggcttggctctgcagtgaggttttcaaacattcccattcaatgctggttttaactctgagaatcctgaggcctggcaacttcgtgtatcaagagcctttcagcatggttaaatctagctcagaaaacccagaaaaccaaaggccaaaagaaccaccgaattccctattgcccaaaaaataacggctgcaggggtctcgacttccttcttgtccatttttatttcctttcactgtacacatgtatttctatatatatacacggaatccttgcgccaggagtggtggctcttgcctttaatcccagcactccgggatgaataaataaatgaatggaatggaaagccttgcttgaaaaagtgtattctgtcttcctttttgcatttaatagtctgtcattaagtatatcccgaaataattgcaaatgtcattttcaatgattcattcaaaaaaaagaaaagaaaaaaaatgagacggggaaagacagaaatagagaaacagaaaatgatattgtttggccatgtccccactgaaatctcaacttgaattttatctcccagaattccctcgtggtgtgagagggacccaggggaagtacctgaatcatggtggccggtctttcctgtgctattctggtgatagtgaataagtctcatgagatctaatgggtttatcagggtttctgcttttgcttcctcctcattttctcttgctgccaccatggaagaagtgcctttcgccctccgccataattacgagacttcctcagcctgtggaactgtcagtcaaattaaagctccttttcttcccagtcttgggtatgtctgtatcagtggcataaaaacagactaatatagtaaattggtaccgggagtggggtattgctgaaaagatacccaacaatgtcacagcgactttggaattgggtaataggcagaggttggaacagtttggagggcttagaataaggcaggaaaatgtgggaatgtttgcaacttcctagagacttgttgaatggctttagccaaaacgctgatagcgattatgacaataaggtccaggctgaggtggtctcagatagacatgagcaacttcttgggaactggagcaaaggtgactcttattatgttttagcaaagagactggtggcattttgcctctgcccgagagatttgtggaactttgaacttgagagagatgacttagaatatctagcggaagaaatttctaagcagcaaatcattcaaaatgtgacttgggtgctgttgaaagcattctgttttaaaagggatacagagcataaaagtttgaaaatctgcagcctgatgatccagtagaaaagaaaaatccatttttggggggagaaattcaagccagctgcagaaatttgcataagtaggaaggagtctaatgtctccaggccatgtcacagaccttcacagcagcccctcccatcacaggcccaggagaaaaaagtggttttgtgggctgggcccagggtctctgtgctgtgtgcagcctagggacttggtaccctgggttccagctgctccatctgtgactgaaaggagccaacgtagagctcaggctgtggcttcagaggatggaagccccaagcctgggcagcttccatgtggtgttgagcctgcagatgcacagaagtcaagaattgaggtttgagcacctccgcctagatttcagaagatgtatggaaatgcctggatgtccaggcaaaagtctgtggcaggggtgaggccctcatggagaacctctgctagggcagtgcagaagggaaatgtggggttggagcccccacacagagtccctactggggcactgcctagtagagctgtgagaagagagctactgtcgtccaaaccccagaaaggtagatccaccaacagcatgcaccataggcctggaaacacaacagacactcaacgtcagcctgtgaaagcagcagggagggatgttgtaccctgcaaagccacaggcacagagctgcccaagaccataggaatccacctcttgcacctgatgtgagacctgtagtcaaaggagatcattttggagctttaagatctgactgccccactggattttggacttgcacgggccctataacccctttgttttggcctatttctcccatttggaatggctgtatttacccaatacctgtatccccattgtatctaagaagtaactagcttgcttttgattttacaggctcataggtggaagggacttgccttgtctgactgtggacatttgggttaatgctgaaatgagttaagactttggggggactgttgggaaggtacagttagttttgaaatgtgaggacatgagatttggaggggccggggtggaattatacggtttgactgtgtccccactgaaatgtcaacttgaattgtatctcccagaatacccacgtgttgtgggagggactcagggggaggtaactgcaatcataggggcgggtctttcccgtgctattctcatgatagtgaataagtctcacgagatctgatgggttttcaggggtttctgctgttgcttcctcctcattctctcttgctgccgtcatgtaagaagtaccttttgccctctgccatgattatgggacttacccagccatgtggaactgtaagtcaaattaaacctcctggccaggcatggtggcttacacctgtaatctcaacactttgggagggtgaggtgggtggatcacctgaggtcaggagttccagaccagcctggccaacatggtgaagccccgtctctactaacagtacaaaaattagccaggagttggggcacgcacctgtaatcccagctactcaggaggctgaggcaggagaattacttcaacccgggaggcagaggttgcagtgagcctagatcgcgccactgcacttcagcctgggcgacaggagcaagactccgtctcagaaaaaaaagaaattcaacctccttttcttctaagtctagggtatgtctttatcagcagcgtaaaaacgactaatacagagagtaatgcataaagacacagaaagagggagagagacaaaaagagaaagagagagagagagagagagaatgtaataggagaaagggagggacaggagaaaaagagagggccctcttcccactatccttccaaaatcagggtttcctcatgaccccttcctcaaggcctaggtgccaaaaaggtcactgaaggaagcacagtcccctcttcctcagcaggcctgaaggctcctgggctatggctgctggtcttcctaagccagaagctataaccctgagccattgggcttcccagcctagcttcctcctgtccaaaatgagaggacaaacaggagttagagagcctgagaagacctgtcccagcaacacacccccctaagaaggcacaggctgaccactgacaactgtttaaatccagcgcccacgttcggctgggatattctgacccactcagggctgccccataaaccagcgcgtggtccggatccaagcgcaccgagaactcgaaacctctctgtcaagctgcccattgggagttaagttcaaagaggacaaaggaaacgagataaagcgtccaatacaagaattacccatttcagacgcacaagacgaagagcacaggcggtgtcaggacatgttaggatccgtccccaactccgccgtcttcatccccacaaagccacggaacacctgtaccccggagcccagctgctcctgcagcccctggagaaatctgtacattccccgccgaggaccctgccgctgggcacactgggaggctggcctgagggaccccgcgcccgtgtccctggggccgctgcctgggagagcgcacgatttaccccaggcgaggtgacccacaggaagtttggtgacgtcggatggcccaggccccagagtgctgtgtgtgctgggggtggagggtggtccccgacaggagccgtcggcgttccagggaaggcacccggtcggtcgggggactcgccggggctggggggtgcgctctacttctccgagcgccccccagggagacccagggcgcaggggcagccccgcgctgggatcccgagccgcagcggcggggcagggccctccccaggaggcgggcacccggggccctttgtcctacgacagcgtcccggccgcgccgcgcgcccctgtgggccgagtccccgcgcgcactcactcacccacggtgaccagcgtgtcgaagtcttgaaggcggttggcaggcggctccggcgaccgcgactcggggctggggcagagctcgggcgcccagtccggggtctcctctgccacggccgcctgggccagcccgggcgccttcatggggacgcactcaggtccggggcgccgggccgggccggagcgctcggggagccgggcttccgcggatgcagcctcggagggcggcgcggcggcatcaacggaggctccccatgcgcgccatgcggcttgtggaggccatcctgcccacccggcccggagcccgcaagacgccaatgcgccttccggtgcgcgcgcggccgggcgcggctgacggagcggcggggacaatggctggccgtcgctcacggcacaagcagcaacggccccaggtagcagcagccgccggcctcgtggggcgggcacggagcgccgggaggcggcggggaaggcgggggccgcggcccgggcttgtagagccaggcgggggccctgcgcattcccagtctcgcgcccgcggcctcctgcagctcggtagcagcgtgcgcgttgaagaggcgggcggaagccgcctgggcgaggcctaggggctgggggcgtcgccttcgcacgcgctccgcccctgccgcgacccagcccaggagccagagacctgggcgtgccccgccaccgtgggcaggcgcggccctggggaggtgctcacgccccctccgcgcccgaggcgcccctcgggtggcacccaggacgacctctcaccgcgacctaccgccccgaccctcttaggcgcagaggcgcacaggtccagacccggctactcaggagggaggaaacattttacaacctgttctctcttgtctttgaagcctgctagctaaaagcttcatctgcatagtaaaactttggtctccaccacctcttatcacaacccagacattcccttctgtgatctcaggtcttcagataaactcaaccagctgtcaaccagaaaatgtttaaattcacccacagcctggaaccccctttcctccaccccctcgcccccacccaccacttctacttgtctcttttctggaccaaaccaatgtatttctcaaatgtatttgattgctgtctcatgccttcctaaaatgtataaaaccaaactgcaccccaaccaccttgggcacatgttctcaggacctcctgagggctgtgtaatgggccatggtcagtcgtatttggctcagaataaatttcttcaaatattttacagagtttgactctttttgttgacaccttttcttagacagctactacaagatgttcttcagaaaatggacggcgcaaactgagaacaagtaagaggtggattcagaaagttaggagatccggtggaggagagaagtgtagttggtggccagggtgacagccattcaccaggttccatagacaaacagttcatgttggagatggggttcaagagatgctagacggagccgtccaggaagaaagagcaggaatgaatggacaaaaagtatgggagttagaaaaactgatgaatttaggggcacatggtaggccttttggagcactgggataaaatagtttcaggcactaagtaaattttatataaaaagaaggcagcccagtgcagtggctcatgcctgtaatctcagcaactccagaggctgagttgggaggatcacttgagctcaggagtttgaggctgcagtgagctataattgcaccactgcactccagccttctagcttgggtgacagaccctgtctccaaaaaataaaaaggcaattactaactccaggaaaaaggaaagaaagaaaacataatcattgtagtcactggttcatctttgaatatcattgcaatggtcattataatggaaacactgatgatttcttaaaccaaatattgtgacctaaatgtttacaagaatgtggtaggagggaaaggacatttgtgattggatggaaaggcaggcaggagagtgtcacagtctgaggggttcttctttcctgctgccccccaaaaacccagtgcactgagaacagcagatgttgcagcaaagagggaggttaataattgcagggacagctaattgagaagaataggagaggtttctcaaatctgtctccctaaaaagttggaaactatggtttttcatggtacttttgtgggcagaagcctggggaactgcaacaactgatagactatggatgaaatctcaggggtgtctaaaactgtctttctgcaggtgagttagttcccaggagagggtatctcaggaccaggtggcatctcttggtctgccaaaatgctaaatctgaaaaatatttcaaagaccattgtttaggttttacaatagtaatgttatctacaagagtagtttgggaagttatacatcttgtgatccctggttacatgactctggtgcagtgaacaacttacatgaaaacacactaagtgatggcaggtcattgattaactatgcctattctttagcaaagttcaagcccctacagtaattctaaccttgttttctgaatgtggctttaatctgcagtcaaggagtggggtcagtttccttgcctcagagtttaactctctctctctctcactctctctgtgtgtgtataaatatatatacacaattatttactatttatttatttatttattattttttgagacacaatattgctctgttgtccaggttggagtgcagtggtgtgatcttggctcactgcagcctcaacttcctgggctcaagcgatcctctcacctcagcctcctgagtagctgggactacaggtgcacaccaccatgcctggctaatttttgtaaatttttttttgagaaggggtttcactatgttcctgaggctgttctccaactcctgggctcaagcaatcctcctgcctcggtctcccaaggtgctgggtggcaccacacctggcttcaaattttaactataaactaacttcctcacgcagttatcttggctgccacactagaataagcaaaaacaaaacaatttagcctgtgaggtctgatggaagatggagtcagtcacgttagatttctcatatttgtttttcttttccttttttttttgatggagttttgctgttgttgcccaggctggagtgcaatggcgtgatctcagctcactgcaacctctgcctcctgggttcaagtgagtctcctgcctcagcctcccgagtagctgggattacaggcacccgccaccatgcctggctaattttttttttttttaatagagacggagttgcaccatgttggctggctggttttgaactcctgacctcaagcgatctgcctacctcagcctcacaaagtgctaggattacaggcatgagccaccgcacccagccaagatttctcacatttcttataattctgcaatctcagtttcaagaccaaatccccaataaccataaggcgtaaaattgacaaatcttgaaactgtagtgtaagaatattacatagcaccatgattgtaaatatgaaaacaaacatttaaaagattgaaattgaatagaggctgggaatgggacattttgatacaaggaggtttttttttaagtactaactctttcatatttcctttacaataatctgcttaaactttaagaacatttggaaaagaaggtgtcacagatgttcccttccagtcagacacgtcttcacttctttggttttactcctcttctctggagagatcatggcagagcttggcaccgtatatatactcatggggcactgatggcagtggacatttgagtgaggcagtctttgttttttacttttggagggtgattgtgaagatgaaatgaaataacccacatggcaatgcccacaattcacaaggcacataaacagggtgtcaggaaatactagctcagcagagattctacattcatcttttccctgagaatgataatgagggatgtttagtactgaaatcagaaagaatcaaaacacaggtatatctacatattcttagatacagcagaaatgtgttagtttttctctgtcctggaacagaagcagatgcagagatgcaagtgttaaaaactgcatggtagaataaatactccatacacttggagtggccacatttagcaaataaaaattgtaataaatttaaatttcagataacacattttaaaatgttttaaattttaattatatttattctacttttttatttttattttttgagacagggtctcactctgtggcccaggctggagtacagtggtgtgattacggctcactgcagcctctacctcttcgggctcaggcgatccccacacctcagcctcctgagtagttggactacaggtgtgcaccatttcgctcagctaatttttgtatttttgtagagacagggtttcaccatgttgcctaggctggtcttgtactcctgggatcaacaatccccccacctcagcctcccaaagtcctaggattccaggtgtgagccactgcacttggccaagtaacagatttttgagtatcagtatgccccatgtcacactgggggcatatggatactaaaaaattattcagtatttatctgaaattcacatttaattggtgttgtgtcttttatctggaaaccttatagatggctgaatttgcagctgtcatgtcactgtttgtggcttaatgaaggaattcatttgccatttacaaaaattcagtacccagaaggagaaaggggatgctgtttggaagaacatgatgtcactgccaatgctgaattaacttggtggtctggaatacacaatctgtgagcatcagtctctgtttttgtttttgtttttgtttttgtatttgtttttgtttttgtttttgagatggagtcttgctcagtcatccaggctggagtgcagtggcacaatatctgttccctgcaacctctgcctcctgggttcaagtgattctcctgtctcagtctcccaagtagcttggactacaggtgcgcaccaccatgcccagataaattttgtatgtttagtagagatggggtttcaccatgttggccaggctgagccttcagagggagtgtggctcggaccgcaccttgatttcagacttctggtctctagaaatgtgagaatgcacatttattgagactcattcagtgtctcaatttatggaactttgttaaaacagacctaggaaaataatactcccaatcagaaggacagaacaaacaagtggaattgtcaacacaacacaaaattggaggtatgtaccttttttagcagtaattgtatattaacttgctcttccaaagtggtggtttggagaatggataaacccaagtgtcaaggatgaaaataatgatcaattgaactccatatggaatataaaccaatttcaccctctcaatataatatgggtaattatttactcttcatgttgatttaatatttgcttttatagaatgaaaaaatataggtacactcacaactaggggccctaatcaatgatcatttatcatgagcatttgattttcaacacattatgaattacatggtggtatagtcaatgcagctcacaatagtggctttgaatctgcattgcccctggccatatgaccttcaacatatattttgaggttgggggaacaggaggaatattttttacgaattttgtgtttgatccaatatggttgtttttgaaagggctgtgtgaccctctgtggaaataaaattgatttatagctgaactggacaagctctatctatctcttgcaactactagaggtctggtctttgacccacggtcagtgggttttatgagatgttgcttaaagtctcatactgggcttggtaattgtagaatagagtggttctttgctttgcatggtgggataagatttcttttttaaaatttttaattttaatttttaatctttgtagatacatagtaggtgtatgtatttatggggtacatgagttgtttttgttttttatgaaacagagtctggctccgtcaccgaggctggagtgcagtaatgtggtcttggctcactacaaccactgactcctgggttcaagcaattctcctgcctcagccccctgagtagctgggactacaggtgtgcaccaccatgtaaagctaattcttgtatttttagtagaaatggggtttcaccatgttgggcaggctggtctcgaactcctggcctcaagtgatccgctggccttggcctcccaaagtgctagaattacatgcatgagccaccgtgcccagccttacatgagatgtttcgatacaggcatgcaatgtgaaagaagcacatcatggggaatgggatatccatcccctgaagcacttatcctttcagctacaaacaatccaatgacattctttaagttcttttaaaatgtacaattaagaaatcccttggtcgggctcagtggctcacgtctgtaatcccagcactttgggaggccaaggctagcagatcacctgaggtcaggagttcaagaccatcctggccaacatgatgaaacctcgtctctactaaaaatacaaaaaaattagtcaggtgttgttgcacgcacttgttgtcccagctactcaggaggctgaggcagcagaattgcttgaacccaggaggcagaggttgcagtgagctgagatcatgccatgccactatagcctgggaaacttcatctcaaaaaaaaaaaaaaaaaagaaagaaatcccttgagggtcaatttctttactgatggcttgcaactggcctaaccacttgtgaagtcagtatggcttcactatatttaggtggttcaattcatgcatcaatacgaaccctgggatcttgcacaagggtctctctgtatcccaatgctggcctgcgcacacactttttctctctcttgctgtgctgtgtccttcagtgttaaataaaagctgtaccacttcacacccactaggatggctacgattcacaaaatccagaaaatagcaggtgtcagccaggatgtagagaaatgggaatctttgtgcattgttggtgaaaatgctcaatggtgcagcccctgtgcaaaacagtgtggtggtttctccaataattaaacacagagttagcataggatccagcaattccacttctgggtatatactcaaaagaattgaaagcagggtctcaaagagatacttgtaaacctatgtccgtaacactgtttttcactgtagccaagaggtggaagcaacccaagtgtctatcagcagaggaatggataaacgaagtgtggtccatccatacaatgagacattgttcagccctaacaaagaaggaaattctgacacgtgctgcaacgtagatcaaccttgaggacattatgctaagtaaaataagccaggctcaaaaagactaatactctatgagtccattcatgtgaagtctctagagtcatccaatgcatagagacaatggtgggcactgggcactgggggaagggaacatgaggagttagtgtttaatggggacagaatctcactgaggatattaaaaaagttctggagataggtggtggtgatggttgcataacagtgtgaatccacttaatgccactgaaccgtgcacttaaaaatggttaaaatggtgagttttatattatgtatatttgaccaaaataacagataggtagatacatagatgatagatacatcatacatgatagatagttcatagctgggtgatgatgatacacaaatacatagataaatgataggtgagacagatagatgataggtgatagatgatagatgacagatggctagatgataggtagatacatagatggtagatagatgatagatagaaaaatagacagatgataggtagatgataagtagatgataagtagatagatagataataggtagattatacacagatgatagatagatgggtagatagatgctacataggtagatagatagcctccaagacaatgggagaataaatgtctgttgtttaagccctgcagtctatggtgttctgttatagcagcttgaaatggactaagacacctcataagaagagatgaggacacagacacacacagagagacgactgtatgaggacaaagggagaacacagagtctacaagccaaggagagaggcctcaggaggaaccagccctgcccacaccttgatctcagacttccgacctccaggattgtaaggaaataaatttctgttgtttaagcccctcagtctacagtcctttgttatggcagctctagcaaaggcatataccttctccatcccctctcctctgataaataccaatatctcaagagaacttggaggcagctgttgaagagagctgagccacaatgttgaaagttattgggtccctgattcaggacttgaaagagcatcaccagccaaccagaaacac[142 bp omitted]tggtgaaacctcgtctctactaaaaatacaaaaaaattagctgggcatggtggcgggcgcctgtagtcccagctactcgggaggctgaggcaggagaatggcgtgaacctgggaggcggagcttgcagtgagctgagatcaccccactgcactccagcctgggcgacagagtgagactctgtctcaaaaaaaaaaaccaaaaaaaaaaaaaaaaacactgagatttggtgttcattcatcagcttaagcagcttatcatggccctaactaacaaagcatgttttacataacaggtactttgcccacagtcaagtgtatcaagatcaaatgatgatgtgctacacctttgctgtagatttcttatcaatacactctttccttgtgtcctctgagagtctacttcactgcagggctgctgctaccagctgctgtggtcatagccttggtgttcttgtctaattaatgagggttcccattaaactagactccagctgttttgacttccagaattgctttaggagagtctctgtggtcattaataaggtgagaccttttggttcccaatacaaagagagaagataatttattttctacagcattttttcccataaagctctatattccgttacattttaaagggcatttcaacaaatgatgtatgaaatggagaacaaaatctgtatggttctgcagtaaagggcatgcaaaactagagaacggctctgaaatgatgtggaaaaacagcaatctacttttctttaaaaaaattaaaggcttatgcttcacataaattcatgtcgattttccaggcattatttggttataacgtctgaggcattgcatggatttactggtacctaaagtgtggatttattcttaagaagcatgcagctctacaatcttgtacagtgaaacgttgggcactcacaaagttatgcaagacaggttatgatgtgggcttaagaaaggtgttgagagctaggagtagagatatagaagaaaaaaagtgtaatattttcaagaaagagtaattagtttgtaagtggaggctactttcagtgttttttttttttaattttgatgttttagtgttatgttttttgagacagagtccagctctgttgcccaggatggagtgcagtggtgtgagcatagctcactgctgtcttgaacttccaggctcaagtgatcctcccacctcagtttcctgaatagctaggaccacaggcatgcaccatcatgcctggctaatttttaaatattttgtagaaactgggtctccctttgttatccaggctggtctccaactcctgggctcaagtgatcctcctcccttggcttcccaaagtgttgagattacaggcatgagccactgtgccaggccaacattgtttttaatatatgacttgtaaggcaagttggggggcattaattccttattaagatgtactgagttgaataaaagcccctccaaccatcaaccccccaaaatatatgtccaagtactaagctccagaatttgtgaatgcaaactaatttggataaagagtatttgcatgtaattaaggaaagattcttgagattagatcactataaattacccaggtggcctttaaatccaatgaccagtgtccttctaagagacagaagaggagacacagacacagaggaaaaggtcacgtggagatggaggcagagaatgtagtgatgtggccacaagcccagggacacctggagccaccaggagctggaagaggcaggaaggatcctctcctagaacctccagggggagcgcacccctgcccacaccttgatctcagattcctggtctccaatactggaaaagagtaaacatctgttactttacgccatccaagtttttgttatttgctacggcatccataggaattaaaaacctataggtatgaattttatgttgctgtcaaaaggcttcttctaggataagtagatatttcacctagatagttgtagctttttctcctcttcattgggatcggaactcagttggtgtcctccatcctcctatctcaatattgattttacttactctttaatcctaacaatgagcctttttatattgcttaattaaatatcaatgtctttctggtcaacatgagaccaaaaacctttttaccttgggcctgagaaagagcagtatttctcctcctcctcttcctcttcttcctcctccttccttcttctccctctttttagagatggggtctctctctgttgcccaggctagagtgcagtggcataatcctagctcactgcagcctcaaactcctgggctcaagtgatcttccagcctcagcctgctgagtaactgggaccacacatgtgcaccactatgccctatttttttgtttttttaacttatttatagaaatgaggtctcactatgttgcccaggctggtctcatacttctggcctcaagtgttcctcctctttggcctcccaaagcactgggattacaggtgtgagccaccatgctttggcatggtggggtatgcagtaggagagcaggggtggtggtagtgtctccatatgtactctcactaaaactggtgtgggcagatactggatgcctacttatttaggggcatctaaattcctgtgctaaattagaaaatagaggcagctcttgaaaggagtgatggcatgaaggagagatgcttggaccaaccaccacacaacccttataaataattgataaccttggttttgatgccacgtcctcttcgacagttgttggttgaaatgacacatgattccaggtgagcttttccagataaattgccctggaacttcagactttgtcgggtgaatcgatgtggaatttcagaatgggctggaatgtctaagatgggcatgtccaatattcagctcagtgtggggaaactggtggtggccagggctggttgcaagctgagttgtaggggtgacagttcacctgagaaacaaaaaaacatgcaagtcctggttcatgaggagtgatttcacaaatagtgaccatggaagtcaatgttgaaaaaacaaatagattcagggcataagggtgcaggtttgttacatggatatgttgcctagtggtggggattggccttctgtcccctaaacagtgaacataataccagataggtaatttttcaaccctcatcctctcccaccttcccccttttaaaggtgtccagtgcctgttattccattctataggtccatgtgtacccatttttagctcccacttataagtgaaaacatgtggtatttgattttctgtttctgagttatctcacttaggatattgacctgcagctccatttatgttgctgcaaaagatacagtgatacagtttcattcttttttatagatgcatagtattccttggtgtgtgtataccacattttcttcatccaatgaacattcaggttcattccacgattttgctattgtgaattgaggtgcaataaaaatgtaagcataggcatcttttttgataatttcttttcctttgcatagataatcattagtggagttgctgggtcaaagggcagatctatttttagttctttgggaaatctacatactgtttcctatagaggttgtacaatttacttctcaccaacagtgtataagcattcccttgtctctgtactcttgccaacatgcgtctgttgtttttggaagtcagtgtttttctacaagaccttcatattggctataaataaaagtgataccttggaagagagtctatttctggacagccagagagggaaatgggaatgatcaggaaacataccgggattataagagagcttcattattttggtctggcttgagtccgtaaatggagtagcctcttagcggaacaaaatttcctccaattataatggtagttgccagaggcaacaacagtgaaagagccatttaaaaagtcaaaaccagaggaatcatttgactagaaccttcaatggctttgagtcactatgccagacagctcaattatcttatctctgccgtgaaaagctgtctttttcttgtacttacatctcttgagcagaatctcacataaaacatgccctaattacatggtccctattagatactacaccagggagtgcttggctttgatggtgcccagattgtctgaagtctgcagaaatccactgcaggcagaggcatttgggtggaccatgttcccaagattatcactttgtaaaatatggctcttgggagggcaaatttgcatgtagggtattctgaggaacaagtgtcgtactgccatcctaagggtcccttatggcaatgtctgagttatgtgtaattacaacagccatgggtctagagcttaagcctcctgcttccatggaaccaatgcattcaaaggttgaaggcacctttgagattttctaggctggctaccaagtcctatgtaggagaaagatgaagtctaacaaagccaggtgattttcagccacacaatgtgtaccttgatctagggtcaggttattcagcctcctactacaccaaattttagaatacaatttttattaggtgggatttaattaatgtcactgatgtataaaagtaaaaagaacatgttacagatgtaagatatatagattatatatttatctgtatacataagagaaatagatggacggatggatagatagacagatggataactagaagatagaaaattacacacatacattcataaatacatatatacatagatggatagatagatgattgacagagagaacaatataggtaaatgtagatagacgatagatgatagaaagatagacaataggtagatagatgttagatggaatagatgacagattaatgataggtagatagaatagatagataatgaatagatgatagaaagatagacagatagacaataataggtaggtagatagatgatagatggaatagatagatagatggtggatagatatatggaatagatgatagattatagatggaatgaacggatagatagaatatagtaatagaatgcatctacctgaaaatacaagagagaagaaaaagagattgggagtttttccactctataactttggggcaaagaaaatagcattaatgaaaaagcaaagaatgggaaaataaaaagtttttatccagaaccacccttccagcaaaagaaaatgtagggcaagcaaaatattaagcatttcatactcacttgtgtaggccacgggaactattatgaaaaggtggatgttgcatgtttcagtatattttttgttttgttttgtttttgagatggactctcgctgtgttgcccaggctggagtgcaatggcgaggtctcagctcactgcaacctccgcctcctgggttcaagcaattctcctgtctcagcctcccgagtagctgagattacaggtgcatgccgccatgcctggctaattttttgtacttcagtaaagatggggtttcactgttttgcccaggctagtcttgaacccctgagctcaggcaatccacctgcgttggcctcccaaagtgctgagattacaggtgtgagccaccacgcccgacctcagtacacttttaatatacacagagctttgccacattttggagggttacctactattgcaatttctggatttttatttcattttttatgtttgtgtctctccattttagtttaatgtaatgcaattcaatagattttctcattaaaataaaatctcagcctctctccattgcataggatgaagcaggcatgatgtagggcaagctcactggctggattcagacccttgaaggaggccgggcgcggtggctcatgcctgtaatcccagcactttgggaggctgaggtgggcagatcacttgaggtcaggcatttgagaccagcctggccaacatggtgaaactctgtctctaccaaaaaacccccaaaaatgaaaatacaaaaattaactgagtgtggtggtgcgtgcctgtagtcccagctacttgggaggttgaggtgggagaatcccttgaacctgggaggtggaggttacagtgagccgggatcatgccactgcactccagactgtgtgacagagaccctgtctcaaaaaaaaaacaacacaaaacccaaaacagacccttgagaagtgagcattttgcagtattccatttgggagctggctattctgcttcctcctaacatcccaaaggacacaggatggcctgagctcccaggtaccctgggtttcccagtaagaattccaggagtgttgagagaaatgcaaattgtctctgcagagcagcagaccccagagcttaaaggcttctctccgttcacagattgctgcatggagatgagaggaaatagagggtgaacagatctcctgctactgcacatgctacttttgatttcccagctggtgtttgaaggctgtgcaaggtgttggtttgcaggatgatggagacccagatcattgtgaatccatgaccgtgtggccgtttgcatcgactcagccttactgcagatactaaccttcattcccctctccagctatgcactggttttctgcataccacttggaatttatgttggctctgagtcatctgactctcacatgagaaagaaccaaataatgacctgttattttaaaagaaagtatctgcatatggcttcttgtctgccgaatgttgcacattaggccttttttattgagtttcaaataaacccctgaattaattctgcaggcaaaggcattgatgttagcaccatttgatcgcttgaatgcacgtcataacagcattttaacgtgcttacagcaagggggatgagaccatatcgaggatgcactt[132 bp omitted]agtacctgttttaagcaaaaacagcaaggaagtaaaaccaaagacaggcagctcggtgccaggcctgaaaccaggcctgggcctgcctggcctacacccagtagttaaaaatcaactcatgacttagaaaccggtgttattcatagattccagacattgtatagaagaacactgtgaaactccctgccctgttctgtttctctctgaccaccggtgcatacagcccctgtcacgtaccccctgcttgctcaaatcaatcacgaccctttcatgtgaaatctttaatgttgtgaacccttaaaagggacagaaattgtgcactcggggagctcggattttaaggcagtagcttgccgatgctcccagctgaataaagcccttccttctacaactcggggtctgagaggttttgtctgcggctcatcctgctacaaggtgggtggatcacttgagtccaggagtttgagactagcctggccaacatggcgaaaccctgtctctacaaaaaatacaaaaattagccaggtgttgtgttgtgtacctgtagtcccatactcaagaggctaaggtgggtggatctctggagcctgggaagtcaaggctgcagtgagtggagatcatgccactgcactccagcctgggtgactgagcgagactctgtctcaaaaaaaaaaaataaaaaaaaaaaaagaagaagaaaagacatgtacaatagattattgtaaactacagtcacttgctgatctattgaacactatgtcttttttctcttatcgaagtgtatatttgcaaagtgggaggatttcttgagctcaggagctcgagacctgcctgggcaacctagtgagaccctgtctctacaaaaaaaaacacaaaagccagcctggcatggtggcatgcacctgtagtcctagctactggggaggctgaggtaggaggattgcttgagcccaggagttcaaggttaccgtgagctatgattgcaccactgtacttcagtctggcaacagagcagaatcctgtctccaaaaaaacaaaacaaaaaaccaaaaaaacctaagatatttgcatccattaatcaaactatttttatctcccttctctgctcccttcccagcctctggtagccaccaatctactctctatctccatgagatccaggttttaagctcccacatgtgagtgagaacatgcagtatttttcttctgtgcctggcttatttcacttaacataatgacctccagttccatccatcaggcctccttttttcacggaggatttattttaggaaacttgcaattgtgagttctttctctatctctttgagatgcaaatcttctcccaaattttcttctagcctcttcctagttttgcaacccaggaatgcctttctcaagacttcagagccatccctttaaaatgcaattattgaaggagatgatacatctgtgtctcagtttttgtagaagggcagattcctagttttgaaaaattccaatgagccaacgcagatagctttacagcatttcctaacctcttcctgatgtctccagttccttctcagcatctcaccccggcacttaaaaactctccagccttttgtttcaacaaagttaagctccttctctcttccgtattgcagtagtcctgactgagtccttccttgaaggtttaacttgtctggtacaattttttctgacaatgtccagatcagatgatcccacagaaacactgagtgtgattttagcctgagaagggggaggatgagaagatagattgggagacagctgtgtaggcaggggacttggccactccctaaacctctcccagtctcacctgtaaatggagtgcataggcagcagtgcttctcttccgaggctggggtgatggaaacagactattgagggcatctggaagggcatttgtgtcagggttagtcctcagggcatggtggccaatgggtttcttttggttgactgttgacaatgcgtttgttgaatggcagcctgcactaggcaacgctgaagccacagaagacaccgcagtgggaaaaccagcataagccgctgcccccaaggaacctcaaagcccaggcagaggaccagccatcccagtcgcacaggtaaagtgtgtcacctgtcaggtgggcttggggtgagcgggtggggggagtgtgtgtgcaaagggggtgtgagtgtgtatgtgtgtgagcacatgtgagtgtgatggctagtgtgactgcatgtaagggagtgtgaacaagcgtgtgagggtgtgtgtgcaagtatgtatgcatatgagaatatgtgtctgtggatgagtgcatttgaaagcctgagtgtgtgtgtgtgtgtgtggtcatgagggcaagttagtgactgaatgcgcaggatgtgtgagtgtgcatggaacactgtcagtgtgtgtgtggcaagtgtgtaggtgtgtgaggacaggcagaagtgtgtcagtgttgtgatgatggaagtgtgaatgagtgtatgagtgtgcaaaaaggtatggagtgaatgtgcatggaagtgtgtgtgtaaactatgaaggcatgtagtatgtcagtatgtgagtgtgcagtgcatgtgtgtgggagggtgagcgtgtgagttagtgtgactgcttgtgggtgtgtttatgagtgtgtgccagtgggtatgagtgtgagagcatgtaaaagtgtgtgtgtagtgtgacagtgtgtgtgtactgtgacattgtgtggctgcgtgtcagtgtttatgaatgacagcatgtgaaagtatgcatgtgtatgtgggtgcatacatgtaagtgtatgagggtgcgtgtgatggtgtaagtgtagggttgtgatgcatgagtgtgagtgtggctgtgtttttcagtatatgactgtgtatgtgtattgggtgtggacctgagtgtgctagtgtgcaagggcaagtgtaaagggcatgagaatgcaagtgtgtgtacatgaatgagtgggagtgtgtgcatgggagtgagtgcatgtgcctgtgtgagtgcactctcaaaagcgtggaagggtgcaagcctcccccactaactcctgtcccctgctgaaatcatctttcccacctccttccctgccatccctacagtgtaccccataagagtgctggctttccttccgggcactctgccctcccccatttcaggcatccctgcacacccgttctgtacaagaaggaggtacctcttctctgcatccgtaggttctgcactccaggggtagctccccatagctggtccacagaccatcacccacccccccaattgccacccagagggatgagagggcttacaacagtggggacagctggtgctagcccctaaccctactaaacttccatagagacccttacagggcttttccattgggaaaagttggggaaaacccaggaacattcagaagtgcagtgaaaccatgtcttggatggcttgggagggatgccgtttatcccgggagacaggattgagtgctagaaggctgggcagggggggagctgtttgaatagctgaggtgagaaagtggggaaaaaagtgacatagtagataaaatacaaggtaaaataaagtatagccacctgaagaaacaatgttggaccatattgggcagatttaaagattatgtgtgggcagtcatgttatctaccatgcctcccattttaaattcatgttttcttagaatgttattattctaacatatatttaactatttcaaagcatagaattcggtggcatttagtacacagcatgcataatattgtacaaccatcatctccatctccctgaacatttttatcaccctcaaaaaagaatatcacccccatattcatcaagcaaaagttaattttaattattaaaaaaaaaaaggcatcagaattttgagccctagtccacactttttgttttgtttgttttttgttttttatttttttgagacagagtgtcgctctcttatccaggctggggtgcagtggcgtgatctcggctccctccaacctccgcctcccgggttcaagcgattcttgtgcctcagcctcctgagtagctgggactacaggcgcccgccaacatcccggctaatttttgtattttcagtagatacggggttttaccatgttggccaggctgttcttgaactcctgacctgaagtgacccacccgcctcggcctcccaaagtgctaagattacaggcatgagccaccacgcccggcccacacttatttttgaaaagcaattcttgatttcatttattttaaaaggatcctctctcttccctctgttatggtgattttcttgtgtggcttaaatagcaaattgaacccactagatggcaccaaacactagcattttttaaaaaaaacagcaactcagaaatcaatgatttttgacacaatctactgttctttcttagaccttcatgtgaggtttagctggggggtgaaaatgcatgaatggcaatgtttttgcaatggaaggagctatctggtgcagagaacccaactatgtaattattattgcatcataggtcaaccaggtgtgcttagaatgtgagaaaaatacaatttccccattatttccaggtgaggtcaaccaaaggtgagtgaaactggctcagtcacctgcttggggcacttccaaggtaaatgctgcaggctcccagaggagaaaattaaatacacagggataatgagactgtgcaaatttttaaaaaatttcataatcccagtggaatagcttatttatttatttatttttacaatggaggtatttacctgtctgagctattatgaataaaaatgcatggtatcagtggacacgtctttgtctataggctatttctatttttttttcttggttacatgtttaggttcatatgctgcactgtttttcaaaagttgtcgtttcactttgcactgtgaatgtaggagggttgtagttgctttatatttagtgcttgttattgtcaagcttgaaaatgttatttatgctcgtggtcatgtagggatatctcattgtgtctttaatttgcagtgctctgatcactaataatgatggtatctttgtttatatacctattggctccgtgtgtgtgagagtgtgtgtgtgtgtattatttttctgtgaagtatttgttcatatattttgtcagtagtctgttgagttgcttgtcttttgtaattgagttgtttatatattctgaatatataataaatatattttatgtaatgttttttcccagtatgcagcttatcttttcttttattaatgatgttgtttaaagataattttgaattttgataaagtccacttcatccatttttaaaaatattatgattcatgcttttagtgtcctatctaaacaaccttttcttttcttttcttttcttttcttttttttttgcaacctccacctcctggattcaagcaattctcctgcctcagtctcccaaggagctgggattacaggtgcacgccaccaagccaggctaatttttttttttttttttttttgcatttttttgtagagatggggtttcatcattgttggccaggctgttctcaaactcctgacctcaagtaatctgcctgcctcggcctcccagattgctgggattacaagcatgagccaccatgctcagccctaaaaaatcttttctataccaagttcaagaagagttgttcatgtgttttcacctagatgcttaatagttcagctttttcatttacgtctatgatacattttgataaaaccttctaaatagtatgaaaaaagggttttttaaaaattcctagaagaatactcagttattcttacaccatttcttgaaaagcttattatttccacattgagtcaattgaccatggatatgtggttctatcttatatcattgttttccctgtctgtcctactgcctgtgacacatgacattgatactgttgccttctagtaaatcttgaacttaagaagcatatgtgctctaattttgttgttctttatctaaattactttgctattctaggtccttggcatttgcaggtaaattttggagttagcttgtcaatataaaaaaaatcctaatgaaacattgattgacatttcattgaatcagtagatcaagtaagaggaaattatcagcttaacaatgccaatactttcaaataatagagatgatatatctctctatgtattggtcttcataaatttctctcatcaacatatatatttaaaaactttcagtgttcaggtgttgcataaatttgctaaatctgtctctcagtactactttctattgtaaatgacatttaaaataatttgttttccaactttttgttactggtataatttaatttttttttttttttttgagatggagtcttgctctgttgcccaggctggagtgcagtggtgcaatctcggctcactgcaagctctgcttcccgggttcacgccattctcctgcctcggcatcctgagtagctgggactacaggtgcccaccaccatgcccggctaatttttttgtattttcagtagagatggg[136 bp omitted]ctgtgaccttctaaatccatttattattctggtagcttttctgcagatgctagagaattttctacatgcaagatcatgtcattatgaataaaaactattttacttcattccaatatatgcctttccttccctccctctcttctttctttctttctttctttctttctttctttctttctttctttctttctttctttctttctttctttccttccttccttccttccttccttccttccactgaataggattcccagtactatctttaacctttttgttttacccaaaaagctaggcagctgcaccctgcattcgtgtttcatccttggtctgcctcagtcatgaggtgcttcctacaaatatggctgtctctgtgatttctcattcaacaccattttctctaaatgttgaatttagactggttgcagaggagctcttaccatgagtccatagcacactttcctcattattgccaacaagaaatatttgtcttggacttctggtttctccttacatggagaactgatttttcctggatattagaatttgcagccagggttattttctctgtctttttccacagccttgtgtggcttctactgcttgtgattctgaatatcttctatctcttattctcataaaaaggaaagcagtgtttctgtttttcacctttattgtgttttttgaaatgatttccaagtagacgagagttcaagatggactttattacaccatttctaaccagaaatatttctcttaaataagcattttagtaacaaggtcttgagtcagctaggaatagtgggtgaagatgtaaaaatacttacactgtttccatttagcaatggggctgacttggtgacataagaggatttcttgataaagaaggagaaaatcagaaaggttatatttgtgaatttcatatgttaaccagctctttgtaacttttagtaatgtatgttaacgtttaagcataaaatgtagctattttaagtatcaggaattttagaactagctttcttcctgaattgtagtaaaaatcaactatttatggaatgggaacctttgtctaaatcaaaaaagaaaaaaagaaaaatcagcgatttaaaactaaaatagtattatttttgcctcttttcagtgatttctggtctctttttgtaactttaaaaaattggactgtcacatctgtgctattatataatgctggtcgattctttgaatagtttttaggatcaaattgagaacttacattttatggaaagtctattccaaactcttcgtaagtgcaaaagcaatggagaatagaaatcatcataacaggacattaaaattatattaattttctgttaagtactgagtttatgttctgtctatgttgcaataatatttctaaaatgaaaaataaatagtttcaggccatttttgtttgcattaagcatgagaacctactctgtcttacacattttgagggaaaaaattgcttccgctggcaagcattggaaatgtgaacattaaattatttatattcagtgggggtacagttgaataatgcacattatatgggatcatttaaaagtaaatggaaaacattatctgaatccaaatatacaaatatatgcaagtggcatgctattgtggtttggttaaataaatgcccttaggaattttaagaaaacgtgggttgccaaatcaatttgtgtttgaacattgaaaagaacataataagacctagaagagggggcatagttttttcacgttttcagagttgtgttttcttttagtttggttatgtgcaaattaagattgtgtcttgaagagaggctattataagtgtgtgtggggagtgcggtgggtggtgtggggtgggacactccccatggactaatttagagtttaaaaataaggcaacatttcctcccattattttggtccatttttaacgtttttatgcatttttaaatttaattatatttattcttctgtttgccaggcaccatgcgaggtgccgaggatgcaaaattgaatagagtcttccattacgagatttcgaaactaaagaacacagcaggcagacagaccaatgaaaagtcagcaatggctgaatggtgatgtgtgtaaagcacacatgtgatgtgtgattgcttgcagaccatggagatttgcatgcaatacccagaaagcccatagaaataaaaggacctgtgaaatggagtcacgcgttttctttattttttacatgttatttatttcttcggtatttccaatactctctccttcatgattttgcttattgcactctctccttttcattccttcctccctccctcccctccttgctccctccacgccttcctctctctctctctcccccaccccttgtctgtctttgtacatacacatagggaagcatgcataaaacatataatggattgagtttaaagaataatttataaaattaatatccattacccaggttgaaaaacaaaacaaaaaacgccaacccaataatgagatgtccagtcattctatcttttgtattgttttattgtctatgtaaatatccctcaacaatacattgtttagttttgcctgtttttgaacttcacataaatggtatcatagggcatatagttttgtctgacttggttctctcactattatgattttgaaatgcattcatgtcgatacatgtacacggagtttattcatattcactgcagttttattgtgtgaatctaccctattttattcatcgagtccaatgttgatgagtgcataggttgttttcagtattctctggtcgtggacaacgtgggtatgaatatttgctcatgggctttggcattttttttttaattgcaaggccctagagaatgagcatgttcaagtttactagaaaattctcactgattccaaggtggttgcgggactattttattctcaccaaaaaaatgtatatgagaacttgactgctttctattcataccaatacttggtgcagccagactattaatttttgccatctgttggcaagcaattttttaagaaatttgcatttctctcattattattgaggttaagcattgttttatagatagtctggccactgtttattcagtctctcaataagtgggtgtgttcaagtttgtggatgttatgacaaagcaatttataactcgtacagttactttttaacatttctgcttccttaagtggtcaagagatatatcattatgctttttaataatttgtataagtttaagaggtacaggtgcaattttgttatagatatattacctactgccttctgggctttcaatgtattcatcacctgaataatgcacattgtactcatgacagaaattctcatccctcaccccctcccactctcccaccctttggagtctccaatgtctgtttttccactctctatatccatgagtgcgcattctttagctcccacttacaaatgagcacgtctggcatttcactttctaagttattttacttaagataatagccttcagttccatccatgttattgcaaaagtcatggtttcatttatttttatggctgaatagtagtccactgtgtagatataccacattttctttttcaatttttttattcttatagatttaatttatttattttattttattattattatttttgttggatatgaagtctcattctgttgcccaggctggagtgcaatggcacgatctcggctcactgcaacctctacttcctgggttcaagcaatcctcctgcctcagtctccagaatagctgggactacaggcatgagccaccatacctggctagttttgtatttttagtagagatggggtttcaccatgttgaccagactggtctcaaactcctgacttcaggtgatccacctgcctcagcctcccaaactactgggattataggcgtgagccactgcccggcttggcctatgctttttgaccagcaacaacagccaatgatttcaagccttagacggagtgacctgctccactccaaggaaaacttcctctttctgcctggccagtattaaatcaaacaatagccctcagcaatttaatgggcaaatcactcctctgccattagccaggggatccacatttatcatttgagagatcagctgttattctgttcttggaacaactcaaattttctaaaacacagaaggctctccgtataccatcccaaagccacctgtcaattgggttaactggttaagtgtcttctctatttcttctttcctggctggccctagccaagtgtcttctcaaacaatcgattagtgaagtgtaaatataagtcattcaactgaccctttcaattgccctttgagaatatctttttagagtatgcagatggagtttgaaaatggtcaactgaagtttttgttgctatgaggaagaatataaaaggacaatgtcaaagcttcattttcttattctttctgatccattggttaaaaattatcttttgaaaatcatttttcaattccctaacagcatcataaatcttacttactgtatcttgtataacagccactcatgtccaggcatggtgactcatgcctgtactcccagcacttggggaggctgaggcaggaggatggctttaggccaggagctcaagaccagcctgggccacatagtgagatcctatctctacaaaaaaatttttaaaaattagccagatatggtggtgtgtgcctgtagtcccagctactcaggaggctgaggtgggaggatcccttgagcctggtagtccagggctgcagtgagctaagattgcactgctgcactccagcctgggtgacagtgtgagaccccatacctaaaaaaccaaacaaaacaaacaaacaaaactcactcaaaatgttgccaaaatccaaatcagtttggaaagggtgacgatttgtatctgtggagatgttcagtaatgcatttagtgaagcaacagtctcgtggaaagaagctcaggcatgaaagaacacactctaggttctgaaagtgtttccagaagtcacaattgtgttcgatcaagaagagcacctatgagtatacggatagctctaaggagattactttgaaagagtaagattctttatctgtgtactttcacagacttaaataaaacacgtgcattttagaatagtcagtgttgcccttaaatatcatgcttggtactccccagtactaatagtttctgcggctctatgtgcagaaaacacaggtctttaaaatgaaagttttggggccaggtgcagtggctcacacccttaatcccagcactctgggaggctgaagcagcaggatgacttgagcccaggagctcgagaccagcctgggcaatatagggagatcctgtctctacaaaaaacatttaaaaaattagctgcatgtggtggtgcacacctgtagtctcagctacaactacatggaggctgagatgggaggattgcttgagtccaggaggttgaggctgaagtgagccatgatcgtaccactgccccccagacagagcaatagaacaagaccctgtctcaaaaaaaggaagtttaaacgaatatatttctgcattctttttttcatctcatactaccaaatggcaaatgaagacacttcattttctttactcaatccttcaataaaaatatgctggagaatcagatgcctttgtgtttgtcgttggtttttatttggggataaataaagcattctttattttcattgcccaaaagtattttatgtattgaatttgcttgaattattctgaattaatgacttgctttttttatgtacaaatatgttgatcataggtctaagctaggtagtataacttttttctggccccctaaaaattcaaaagttttaagaatatttttattttttctttattatgaaaataacatgaacgccctttggaattggtgatctcctggggaagataaagttatatacttataaataaataataactcaggttcaagggatcacataaactttctacagagaaaatagcacaagaagtcaacacaagacaaaattaagctgtatctataaagtatcaaaagtcactaagtgaaaaaagccaattatgaatgtttaattgatgattaaattttcattttttagcctgtacacatggcttgctttctcattccacaaatttgagcaactgtatatctgtagtacataaataactgggtgagaagcataactaggcaatacaatattatctgcaacaatattttggttgttttgccaaatagaatgagtgtatactcatagatcaataatttttctctttgaatttaaaagacattcaaagaaatttagatagagtgcatgaatagaaggccttgatattttctcattttcctacttcttgagaacaacttgttaaatacttgcactatattgacctttaaagatgtgccccttatgagggagaagtttttttgtctttttttagacagggtcttgctctgttgctcaggctggagagcagcagggcaatcacagctcactgcagcctccacctcctgggctcaaatgatcctcctgccttagcctcctgagtagctgggcctgcagactgtgctaccatgcctggctaatttattttattttatcttattttattttattttattttttgtagaggtggggtctttctatgttgtccagactggtctcaaactcccaggcttaagtgcttctccaacctcagcctcccagtgctgggattacaggcgtgagccaccttgccctgcctggaagaagttagagccagagttccttcagggaggaatccttcttcattttaaagttctgttttcccttattccagagccatgtattaaaaaaattaacatatcatttcgccttttgattacctgattcttctgtttgtccctcagaatactttaccagacatataacaatatatggcaataattagactccaactatttgctatgagaaacaaatgtatttattcattggtgtttaatcttgacatgaaaagaagtcaaaaaccgtaatttgagcagttaacacatgatttattgttaaagggagaaagtctaacgttgtaaattatttctcacagcaaac[139 bp omitted]aaaccccatctctactaaaaatacaaaaaattagccagcgtggtggcgggcgcctgtagtcccagctactcgggaggctgagt[149 bp omitted]atgcacctgagcaatttttttttttttttttttgagacaggtcctctctttgtcacccaggcttgaatgcagtggcatgagtatggctcactgcagcctcaaccttctgggctgaattgatccttctgccttagcctctcaagtagctgtgaccacaggcatgcaccaccacacccggctaatttaattttttttttttttttttgtagagatagagtcttgctatgttacccaggctgctcttgaacttccgggctcaagtgatcctcctgcctcagcctcccaaagtgctgggataccaggcatgagccaccatgcccagcccgcctgggcctttctgaaaaacatcccagtttttcaggagaacaaagagggttttctcattctaccaacaatagaacttccccaaagagaagcgggtgtgctagcaaggtagaaatggttccaaatgatggatgactgcacacttggcattgacaatgagtcctagccttctgaaagctgccttggcaataacatctatcagcagagaatgtttcatggaaagacactggccatgcgtccccttttctggttcataaagagttcagcatgagaaactatgagtcagagagacagaaaaaaatatagacactttcttttcctgagatggaaatttcattgcttaaatgataaatatacttacagaacagccaaaacgatggtgttttaaaagacatcaaaactaaagccaattctcttttctgaaggaaacatgaggttgtaatattttaatgcggctgctggaattgtgtgtgcaagtgcttatagaaagagtggggacaggacaatttcttaggaagtggaaattatgaaattgagtgggtctagaccctgtcagcccaagttcagatttgaaatgtggtgttcacatgccacttcattaagctctttaaatacattgaaattaatgatgtaaggtacattttgtttaaaaacatgctgtaagcagggaaaaaaaaatcagaggtggttacatagataacaattgttctacattgtaaatttctggaaatttgaaatccatacaatgtggctcatgcctgtaatcccagcattttgggaggccgaggctgaaggatcatttgaggtcagaagttcaagaccagcctgaccaacatggtaaaaccccatctctactaaaaatacaaaaattagctggaggtggtggcagacacctgtaatcctagctactcgggaggctgaggcaggagaatcatttgaacccaggaggcagagattgcagtgaactgagatcacactactgcactccagcctgggcaacagaacaagactctatctaaacaaacaaacaaacaaaacaaaaaaaccccaaacccaaccaaaaaaattgaaacaccaaaacactgagaatatatatatatatatatttttttttttcctatgaaaccaatgatgtatcactttggggtcttttacatttcttttccatctgtttttcaacttatagtaataatcagatcatctttcataattcagagtcatagaatttatttctggaccttttttgatattgatttgcaatgtcacaaaatttctcagctagactctcaaaaactggctatgaacatagtatgattcaaaatacatttgcagaatgcagtttccatttttatggtccaaaacaatttatttgaaggaaaggggacaaatttgtaattgagatgggatggatgagggctttgtcaactttctaggataatacttcattatggagaaatgcattgcaatttctaatacagagaagtgtgattttctacatgtgtatcttttgttatttaaatggaagagatatggggattatttcacatttatgaatttttaaaattcaggccacaatgatgaaagcaagcaagcatgaggacgtgacacactgccccgaaacttagtggctaaaaaaaacaaatactcattgtttggcacaagagtgtctctggttttgtaatttggactgggctcagctgggtggctcttcttttcttgcctgggctccctcatgtatctgtggtcagttcacaggttggctgggggctggagggtctaggacagactcaggcaaggtgacaactcatttcatctcctagtgatttgaatgaactccagtagtttggctctgatttgtatacatgggacttgggctgaggtccaagagctgaaacatgaaagaccttgtgaagcccaggtttaaaactatcatgctatcccttccactgcatgctgttgactaaagaaagacaatgcagattcatggggagggctagtgcacttcacttgttaatgggaggagtgacaaagtcgtcttacatagggtgtggacagggaggggctatggcaggtggccagtttgcaatgaaccacaaatagtaaaacatactattgttgagctctctaaaagtatattatatttcatctaaaaaaataaacaatctaagagtagtgttgaaatctctctagaaaagaccttatagctagatttttaggctttcatattgattatgatgataccaaaaaattaaactattggattaacttggaaattaacaaacaaagcacagtatagcttttttaatggtgtgcttccattattcattatataaagtatttaaatccaggaacagatagtagggattgtcaaacagaagcactttaactgagagccatagagatgtatcactaaagtatcacttaactctagccctttaataatgcacactcacgtttttaagggaaaagagtgaaataaaatagagcgtgtaactttcatataaggagagggggaatatagaaatagattttaactcaatcaattcaagagtaggcagcaaagaagaaaatgaagagcgtttggtaaatggaaaacacaaaataagcaggagaaaataagatccgatatatcagatataagaataaatggagttctctttgccatcttttctcctcccgtggagctgctgccatgaatgtcgaggtttgcagtttcagagggtacaagatctaccccggacacgggaggtgctatgccaggaccaatgacgagaaggttttccagtgtcttaatgcaaaatgcgagttggcgttccttgccaagaggaatccttggcaggtaaactggactgtcctctacagaaggaagcacaaaaaaggacaattggaagaaattcaacagaaaagaagctgctgagcaaattgcagagggcccttaatggtgcaatctctcattgacataatggccaagaggaatgagaaacttgacattagaaaggctcaatgagaacaagctatcagggctcataaagaagcaaaaaaggctaagcaagcagctaaaaagaccgcaatggctgctgctaagacacctattaggttggtgcaaaagtaattgcgtttttgccaaaggcagcacctaggcagacaattgcaaagcctgtggaagtttcagctccccaagttggtggaaaacgctaagccgacagatcagattttaaagtaaagattggactataactctaggttgtgctggagattttattctcataataggcatgttgggccttacatggtcataggtgaactaataaagttaagaatgtaagaggtaggtattttattaaaaagtctatttgcttagctggggtgtgtcgggcacattacaaaaacttctttgtcttaactttttggttacatggctgtaagtactaggatgttccatggctgtaagtactaggatgttacatggatttgcctggctcggtgacaaatgcctgtagtcccaacatttgggaggcctaggcaggcagatcgcctgaccttaggagttcaagaccagcctgggcaacatggcaaaaccctgtctctacaaaaaatacaaaccctgtttctacaaaaaatacaaaaaatataaaaatgaactgcaggtgcatggtggcatgcacctgtagtttcagctatttaggaggtggaggtgggaggatcacatgagcccaggaggtcgaggctacagtgagtcaagattgcaccactgcactccagcctgggtgacagcgagaccctgtctcaaaaatgaaaaaaaaaggatgtactttttagactattttctagttaaattactttttcccatgatagacaaatttagtttatattgggtttgccttgtagccattggtatcttgcctatcatttgctaataggtgagttgaaggtgcttaaaactatcagctgtattaatctgctcttgcttacagaaaatatgcctaaatgaaaagcatggctgcttgagtaaagagtatccttagctagactcctggagtagtttgttgagctgggggtttgccagagccatgctaaattgcaaaaatgtctgaataaactgctgatattcaagagatatgtatattgaagatgtgataaaatagtagtaatcatgacttacatgtaaagcataggcttgtccttctacagaaagtagatcgtttttaacctgccagcctgtgccaagttgcaaggatacaacagtggacaaatcacagtgctctttcaggaaacatcagaacactaggtgagggtatagtcaatgtcaacattttcctccattcccattctttccaaggtgatagaattaatttttcattctagtgcatgttacattcagacatctaagttttgcagataaaatgagtaagtccctttgggaacctgaaaatggaaaccatatgtaaaatcaacataagaaatatgtaaggctgggtgcagtggctcatgcctgtaataccagcactttgggaggctgaggcaggtggatcgcttgaggtcaggagtttaagaccagcgtggccaacatggtgaaaccccttctctactaaaaatacaaaaattagctggatgtggtggcacatgccttaatcccagctactcgagaggctgaggcaggagaatcacttgaacaagggaggccgaggttgcagtgagctgagatcatgccactgcactccagcctgggcgacaatggaagactccgtctcaaaaaaaaaaaaaaaaaaaaagcaaggtaatacagacttttgctcataaaagcaaaatgttaagattttgcttgggggaaaagctctcttttttcgtatagacaatattatgctatatttaggaaattactgggaaaataaaatcatacccaacttgaatgtagagctatgcttgataacttttgggtactaaaatgtccccttaaaaataaataaataaataaataaatagataaataaatgtgaatggattaaactcacctcttaagagacagattttttctaagagtgaacaaaaaattaaaaatttaaggagacacaagtgaagcataaaaaacataaaagtttgaaaataaatattaaaaacagagaaaataacacaaataaagctggcataataatgtattagaaaaacaacttccaggcagaaatcattattggggattacaggattcactgcttaaaaaaaggaacaatttactaggaaaatataataatctttaacctatatgaatctaacaaaattgccctaaaagtagaaagcaaattgtcgtaattatagagagaaattaaaaatcacaactgtgtaaaaaatttaatgctctcttgaaatatgtcaaacggattttttaaaaaagaataacactgatatcaacacatagataatcaggttctttccaagcacagagacaaatggtataggatttgagcaattaaaactaccaagcattgagaatatatatctttccaagtatatatggcacatatcctttaagtgactaccacactatgttaaatagcgtttttcttttacaaattttaaatgtgattgagatagcattctttaattaaaatgcaaaaatagaattaagttataagaagtagccttttccacccacacatttggaaagtaaaatcaaaattataaataattcactcattaaatacttaaaactacaaacaaaatgacaaactgtttagcatagcatcacgtgaaagtaccttgtacccaaatagataacttgatagtgggaaggaatgtataactttaaatgcatattctagaaaataagaactgctgaaagttaatgaattaaatattcaactcaagaatttttaaagcagtgaacaagaaaatccacaaaagttatcacaacaaagcaaattaataaaaacaaatgaataaaatacaacacaacaaacagaaaattaataacacaggaacagaaaaccaaataccacatgggctcacctgcaagtgggagctaaacattgggtactcagggacacaaagatgggaattatagacactgggggctactggagggggaggggttagggggtgttgaaaaactacctattgggtacaatgctcacttcctgggtgatgggatcatttgtactccaaaccttaatgacatgtgatttacccatgtaacaaatctgcatctgtaccccctgaacctaaaataaaagtttaaaaaaagatatacagacaaaagtaacaggaaattaaaacttgaaaaaatagagtggataattaaaccaaaagccattttaaaaaattaccaatgaaatagaaaactctggcaagattaagcaagaatataagaatgctgagaccagtaaacaatattaaatacaaacagggagctaaaactaacagataaaggcaaactgaacatcttagaatagcagggggaaaaaggcaaatttcagtagattaaaaaaaattggaagaatatgtattgttttaaggatgacattcaaacaaatttcttattacattgactcaactctgtgcaattgaaatatttcattactcaaagtagaaagtaattacatgttaagcatcttaattggtgaacagactgccagaaatttgaatgatcaacctacacatcatttctagcttgaagcataataaatgactcaaaacagatcctgctaatacatttagaggatatgttgtttttcagtgaaagtagtaaaatagtttcatgggaaatttatgagaccagaaaattatgttctactttggaaagattacaaggctaaactctgttgtgagaatgactgagatatcccttcattcaatgtcttaacattttaactgacagacacatcatagtacatcttttctccagattggcaacattttgtgagctttaatatgggtaataaaatgccattatttaataatgatgccacaatcttacattttttatatggcttagcattgtacaaaatgtgttgacatgttgaatctgtttacccatttaattgatatgtaatttgtccacatgaccacttgctccttcttcatcatcatatctaactatctatatattttttgagacagggtcttgctctgttgctcaggctggagtgcagtggtgcagtcatagctgtcttcagcctctacctcctgggttcaagtgatcctcctgccacagcccgtcaagtggctggaactacaggtgcatcatcaggcccaactaatttttttatttttttattttttgtggagacagtgtctcaccatgttgcccaggctggtctccacctctggctcaagtgatcctcttgcctgggcctcccaacttgctgggatcaaaggcgtgagccaccatgcctggccatattaatattataattttttttccacaaatgtaaaaccttagcataattaaggatgactgacttgctcaaggtcatatatctagaaagtgtctaagtcgggactaacttggatctcctgacacatagattagtgttatttccactagaagttttcccattctttttttttttttttttgagacggagtcgcgctctgtcgcctaggttggagtgcagtggcgcgatctcggctcactgcaagctccgcctcctaggtggcgcccgccaccatgcccggctaattttttgtaattttagtagagacggg[133 bp omitted]agacattaatcatttcttcatctgtctaggtctgtctaggtgtttgtgtgtgtgtgtgtgtgtgtgtgtgtgtgtgtgtatgtgtatatgtgtatgtgtgtgtgtatgtgcatatgtgtgtgtgtgtatgtgtgtgtaagggcaatgtgaccccttgacttatcatcccctgaaatctccaaaacgtagatcttgggtgttatgaaatatataagaactttgggacctgctaacccaaaattggaagatgatgttaatttttccatctttactataaaacctagcagttcaacagccaacaatagcaactgaataaaactaaaaattggagcggtcaacttcatgagcaaactggacggcaggcttgttatcagggggtgggttggtaggtagcaaatgaaatattgaataaaagctatggtccaaaagccacaaatggaaggcactgaagacattaccaagcagggttgatgggtgggcccacacaacatacatatctatagacaaatcaagtgaagcagtcattctctcagtcttgctacaagatatggtaggtggccaatgtcagtcctgctaatatctgggctccaacagaatacattggaaatctcaatctagtctctttaaaatgaagccaatccactgccttcaaaaatcacacctctgggccaaacatggtggctcacacctttaatcccagcactttgggaggcccaggcaggaggattgcttgagcccaggagtttgagaaaagccttggcaacatactgagacctcgtctctaaagaaaaatacaaaaattagccaagtgtggtggtacacacttgtagtcccagttactcgggaggctgaagtgggaggatagctagagttcaggaggtcgaggttgcagtgagccaagatcacgctactgcactccagcctgagagacagagcaaaaccctgtcaaaaacaaaacaaaacaaaacaaaacaaaacaaaacaaaacacccaaatattcccaaatctgaatggacaaggagcttatatcaaagaattttttttttgagtaaatagaataaccttatgttatagaacacaagggttatggggtttcattttctatgtcaaaccaagcttgtttaaaagaaacctcaaaaagccacttaattcagagctatagagaaagcacaacattcaataaactcagcaatggtgaacatcaaataatttgctgtggcaataaaacaaaacaaaaaaattattttattgaaaacttttaagttcacgggtgcatgtgaatgttccataggtaaacttgtgtcttgtgggtgtgttgcacagattatttcatcacctgggtattgagcttagtccccattagttatttttcctgatcctctccctcctccctccctccactctctgaaaggccacagtgtgtgttgctcccttctatgtgtccatgtgttctcatagtttagctcccacttataagtgggaacatgtgatatttggttttctgttcctgcattagttggctgaggataatggcctccagctccattcatgttcctgcaaaggacatgatcttgttcttttttatggctgcatagtattctgtggtgtatatgtaccacattttctttatctagtccatgttgatgggcatttaggcttattcccattcaaatgcaatcatggtgctaacatagtgctatgagatcttgagatgtgccaaaatataaaatagaacatgagatctttttggaaacaaatgcctataatggagtgggaggcatttatgtgaagccttttatgtgtaatagtagccaagatagagctaaaaacaaatgtgtacagtactttctccactcaaagacaatggtgttagatacaagaccagatatccccatcccgctgtgttttgttggtcaaaacagagtgagtggggaatttgattcaaactcatcaccactgttgtttaaacagagaagaccaagtgccattgatggtttgagctagtttaaatggttagaaaaggcagaagatgtaaattaaagttttgttctggtctttcaaaaccttctgtaaactgaaaccctactgagccatcccacccttcttactatccaccctaatactatcttaggcatatacatcctctatcttctactgtgatatctttacattgtattgctcttctgttgctgtatgtcaaatatctggaaatgtacacactttttttttttgagacagggtcttgatctgtcaattaggctggagtgcagtggcaagattacagctcactgcagccttgacctcccgaactcacgtgatcttcctgccctagctgcctgagtagctactcaggcctgggactacaggcatgtggcaccacgcctggctaatttttgtattttttgtaaagatggggttttgcaatgttgcccaggctggtctcaaactcctggactcaagcaattcatccgcttcagcctcccaaagtgttgggattacaggtgtgggccaccatgccctgccaggctatgtcttttatggaaacccaactgaagaaaggattgcattcaagctcccttaggtagtcggaaaagtccgtttactgggaaaagtccactctaggagcttagtgtggtcccccgccaacagtcagcaagaaagcacaagactgaggtctctgttttcttgctgactgttggccggggaccacactcagttcctccctagaggctgcccccgggtccttgccctgtggaccccttcacaggcagttctaagcatggctgtttgctttttcaaagtcagcaagagaaagaccagcaagagaatcttaattaatttgaatctctccctcagggaaggcttgaaactgtttttaaagactcacctgattaggtgtggcccactcaaaatcatcttaaagtcatgactcaaagtcagtttgattagagaccttaattacatgttcagaatctctttacttgcccatcaatggtaggctgatgaaagaaaatgtggtatatatacactgtggaatactatgcagccataaaaaagattgagatcatggcttttgcaggaacatggatggaactggaggccattatccttagcaaattaacataggaacagaaagccaaatactgcatgttctcacttatatgtaggaactaaatgatgagaacacatggttgcatagtgaggaacaacacacacactggggcctacttgagggtggagggttggaggaagaatgggatcaggacaaataactaatggatagtaggcttagaacctgggcgatgaaataatctgtaaaacaaaccccatgacacaagtttacctatataacaaaccttcacatatgcccctgaacctaaaataaaagttaaaaaaaaataacaaacatactattaccatatgccatccccgaccaaaaaaccccagtaaaatctctttacctttgccatataatataccttaatcaaaggattgactagaccattatattcttagcatccacagcaggaagtagaaatcatggggagcatcttaaaaactcttccgaccactgtccacctctgaccactaatggtatacatcctttccaaacacaaaatgcattcacatccttcaatgctcccaggagtctccccctactcttcttgaaaggatgtcaccctctatctctaagctgttcttgagtccccaacttacactggcttcaattatttaaaagtttatttttcacaataaattgagtcacgtatgtttgtttttctcccttgctactttgagggtagaaacattccttgtgtttctttggcagatcacagaagctaaaatgtagctcagaaaaattgtgtacaactcacaaatacttgttcattgactggacaattttgcagggtgagactgcgaaaattaagggcccctaaaaataaagagatggaacaaatatgtaagaaagagccatgaaaactgaattctcaagtaattcacgatggctgaaatacttaggatattatattatcctaatacagtctaaaaaattctaatatgtatattaatgatctcattatgatagtgagattaatagatatattaatgatatcaaggtgagggaaaattgtgagctatgtgagatgttcttcaagcatcagcaacttcatagttgaggtaatccaatagggagatacatttttaaaaagtctcttggggatggagcgttaaaatctttgatacagagaaaaattctgcaaaagtgtgaattagaaactctacactcctctctgtggcatcgccagattgttttaatgcatgtgcattctcaaacagccaaaaagcaaacaaatatttcacagggttgattagcgtctgccttcgataaaaagaaaaaaaaaatgggagcgctagagggagctcttgcgctgtggaagatagataccaaagcagtcctgcatgattctttcccgcttggacaaaaataaatgaataagaatgaaaacaaaccccgacagttagaaaagaagagctacttttattctcagtgacttgatgatcacagcctaccctgctgaggttgggaaagaaaaaaaaattgggagcgatagagggagctcttgccctgtggaagatagataccaaagcagtcctgcatggttctttcccacttggacaaaaataaataagaatgaaaacaaaccccgacagttagaaaagaagagctacttttattctcggtgacttgatgatcacagcctaccctgctgaggttgggaaaggctctgtgggtttgctttgctggagccattagtgttcagggagcaagcagtgcagggctgagctgcccaagtcagcagcctaattaatctcgcaggctcagtgggaacctttgggtttattcattagctgcaagggtgaagccagacgcatgtgttcacgctgaggcaaaatgagggcagagcaaacaggggtaagtgcatgggtctgcatgtgtcagagagtgagatgaggaaggaaaagaacttggacatccatcatcaaaggcaaaacaaacctggcagacctgtttcaccaccttccaatcaatacgtcttatctattcaaattttctgcacgctgcagcaacattcgtttgctgatagattctagaatgtgtgcacccgtgcatcaaaatgaaggcatggtcttccccgcactttggggaaaaggacatcattgccgtcagacacttgatacaaaatattagttctagccaagtgttcgaaactctagcaagtgcatataaatgaactgtttttgtttgttctttgtgtttttatccttacatctggtgggacattttcttgagtagctctttttttttttttttaagttttattgaggtataattgatctgcaaaagaggcacatatttaatgtatacaatttgatgagtttggacacatgtgtgcacccattttactgttgggactgctgttgtgaaacctcagttcttgtcttcttagtttcaaagaatttaaacaagagacacacagcaagggacatgcagcatagagcaatttcttgtaaaggaaaaagaatattttgaaagtttggtgcagaatagacagtacaccctgagagagagaaatttcagggcaggcttctcataagggtgagacagtattgattattgctggagaaactccctttatgggagtgttacatggtgattcataaggggatgggagaggtgttgctagtaagcatgttctgggtggtcctctgggtgcacatgcccagtagctgtacatgcttgttcatggactgcaggtctcattagcatcttatatctctaccgaggggtattttttaactattaaaatgagcaaagggtcagtttgaggacaggtaaaataaaaatgcacgtggtctctagaagggaaagtccctactgaagatagcttagcttgaatgagctcaatgacaatgcaaatgctgaggtttattgtgttgattgtatggtcaccagagttgctgtgtcccgaggacacggtcactttctttaatactatcgtcactatcaagataagaaacatacccattacctccaaaagctttttctgtccctttttctttttcggatttttcttgagtgtgtgtgtgtatatgtgaggactaaactctgatttcttatcttgcccaaattcctatctcaagagtctggggagccatgccctacaaaccataaattctcatcagatggtttcatttaaccctatatattgtgacttaccttccaatatgactctggcataatgttacatgacaaagaagaaaataaaaatattttaccccaaaacatgtttctttgccatattttgaaatggctttgcaaagccatcctttgcgggggaaaatgtgcatctgtaaagaatctctattcacatagctagatctttttcttccaggccctcctaatgctgaagagattaactgagagtctagcacgttttaaagggtctgaataggaaatatttgtcatctattatctctaagggcagccactatgagacttcaaaagaaccttggtcttcacagtcttttatcttaacctgaacatttcctttctattgatcccaggtctttagatgaactcaaccaattgtcaaccagaaaatgtttaaatttacctatagcctggaagccccctactttgaattgtcctgcctttctggaccaaaccaatgtatttctcaaatgtatctgattgatgtctcatgcctccctaaaatgtataaaaccaagctgcgccccagccgccttgggcacatgttctcaggacctcctgagggctgtgtcatgggccatggtcacttgtatttggctcagaataaatattttcaaatactttacagagtttgactctttttgttgacaacgtgtgtgataagaacacacaacatgagatttatccccctcttaacaagtttttaagtgtaaaaatactgcatgattccatttgttttgttatgatatatgttggtttttgttcattggtcctggcccataactcccatagccctggttacagtcttttttcataatattgggtgttttcaggcctcaggggcacgtctttcaccttctcctgcattcctttcattctaatgttcccctgcctttctgagtgtgggtttcaagaccctcctgatacagacaggaaacagggaaatatcgggtagaagagggcggttcccctgcaaatgcgtcaccctcaagcctggaaacctgtgaccctaactgggaacaggcattcccgtttttgcacccaaaagttgccttttggcccaccacacccatctatcctgtacccatataaatcccaaacccccggttccagaaggagatgagagacgaacagaagagcagaggagtggcagaacggtatggcagagagaagaaaagaggcatctgaacgctgagaggagttcagctggggatggtcggagaggagataggccatgggcagccaaactccaggggaagaccatcttcccactccatccccccttccagctccccatccatcttgctgagaaccacctccaccactcaatacaacccccacactcatcttttaagtccttgtgtgacctaattgttccgggatgctggacaagagctcgggataaggaggagaccacccctcatattgtcttatgcccaatttctgcctccaaagaaagaagaagtaaaaactaaaaggcagaaatgaaatccacaagcagacagccccgcaccacaccctgggcctggtaattaaagatcgacccctgacctaatcggttatttgtataagaaaagcactgtgaagatccctgtcctgttctgttccgttctaattactggtgcatgcagcccccagtcacgtaccctctgcttgctcaattgatcacgaccctctcatgctgacccccttagagttgtgagcccttaaaagggacaggaattgctcactcagggagctcggctgttggagacgtgagtcttgccaaagctcctggccaaataaagcccttccttctttaactcagtgtctgagaggttttgtctgtggcttgtcctgctacatttcttggttccctgaccgggaagtgaggtgattaacggacggttgaggcagccccttaggcggcttaggcctgccccgtggagcatccctgtgggagactgcggccagcttgagtgacgcagatcctgagtgtgctcccaggtaggcaattgccccggtggaatgccttgccagagcagtgcgtggcaggcccccgtggaggatcaatgcagcagttgaacactggaaaggaactggcacttggagtctggacatctgaaacttggtaagactagtctttggaacttgccccactccatctgagtggaagtgtggcctgatcacccacagtgtgcctgtaccagcacttcagttttttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatctagtctatcattgttggacatttgggttggttccaagtctctgctattgtgaataatgccgcaataaacatacgtgtgcatgtgtctttatagcagcatgatttatactcatttgggtatatacccagtaatgggatggctgggtcaaatggtatttctagttctagatccctgaggaaccgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtagttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagttcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagtaaactcatgatttggctctctgtttgtctgttgttggtgtataagaatgcttgtaatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattggaccccccacagtggttaagaggacaggcagcagcagtactagtagcaaagggagagttagttaaggaaggttctcgccccacccgccgagggaaatcagcaccataagtcttgtccaagccaacaccagaagaatcatggcaggaattggtaccagcagtatccccttcttattgagaggaagggctcctcactcctgagcccacagcatctccacctccactagatagccacactcctagaccatccagagtagacaaaagaggaagtgaagccatgggagaaactcttgccttggtggctcacttacggcccaagactggaatccaaatgcacctgagagagcagcaatatactggggtagatgaggagggacacatggtggaaaggcttgcctttgtgtatcaacctttcacctctgctgacctcctcaaatggaaaactagtactccatcttacaccgaaaagcctcaagctttaattgacttgctgcaagctattatacagactcataatcctgcttgggctgatcaccaccagctactcatgtacctctttaatacagatgaaaagcgaagggtgctccgggcggcaataagtggctagaggagcacgtcccaaccaattactgaaacccccaagaatatataagaattcagctgccaggaacagactcccaatgggacccaaacgagggaccagacatggagaagctaagacggtacagtgaggcattaatagaaggtctaaagaaaggggctcaaaaggctacaaatgtaaataaggtttctgaggtcatccaaggaaaagaggagagtccagcgcaattctatgaaagactgtgtgaggcttaccgtatgtacactccttttgatccagatagccctgaaaatcagcacatgatcaacatggccttagttagtcaaagcacagaagatatcaggagaaaattgcagaaacagcctgagtttgtgggtatgaatacctcatagttactggaaatagccaattaagtgtttgtgaatagagatgcaacaagccgcagagaaagccgtaaggaaggcgaacgccaggccaggcgagaacgccgacttactggccacggccattaggggaattcccccgaagggagtgggaaagggaggttccgggaagaatacccagtctaatcgcccacgcttgcaacgcaaccaatgcacctactgtaaggaaataggacattggaaagataagtgtccccaactgaaggaaaagcaaggtgatttagaacaaaagacctcagataaagatgagggagctttgttcaatctggctgaagggctattggactgaaggggaccgggctcaagtgcccccaaggagcccacggtcaggattacaactgggggcaaggacattaagtttttggtggatactggtgccgaacattcagtagtgaccactccggtcgcccctttatccaagaaaaccattgatataatgggagcaacaggagtttccactaagcaggctttctgtctactgcggacctgcttggtggggggacatgaaatagttcagttcttgtacatgcctgactatcctttgcccttgctgggaagagacttgcttagcaagatgatagccatcatcccctttacaaaacagggctctttacagctaaagttaccgggaacaggaattatggcccttatagtccctcgggaagaagaatggagactttttctaactaagccaggccaagagataaaaccagctctagctaagtgatggccccgagtatgggtggaggataatcctccgggactggcagtcaaccaagccaccgtactcatagaagttaagcctggggcccaactaattagacaaaagcagtatccagtttccagggaagctctcgaaggaatccaggttcatctcaggcgcttgaaagcctttggaattatagctccttgccagtctctatggaacacccccctcctccctgtccctaagccagggaccaaggactatcgatccgtacaggacttgcgcttggtcaaccaagctacagtgaatgtgcacccgacagttcctaacccttacacattgttaggattgctgctgccagctgaggacagctggtttacctgtctggactttaaagatgccttctttagcatcagaatagctcctgagagccagaagctgtttgcctttcagtgggaagatccggagtcaggtgtcactactcagtacacttggacccagcttccccaagggttccaggactcccctgctagctttggggaggccctggctcgagacctgcaaaagtttcctgctaaagacctgggctgcgtcttgctcctgtacgtggacaaccttctgctgggacactccacggcagttgggtgcgcaaaacggacggatgccctgcttcagcacctgaaggactgtgggtataaggtgtccaagaagaaagctcagatctgcagacagcaggtaagctacttgggattcactattcagaaagggaagcgcagcctggggtcagaaagaaagcaggtcatctgcagcctaccagaacctagaaccagaaggcaagtaagggaattcctaggagctgtggggttttgcagattatggattccaaactttgcagtgctagccaaacctttgtacaaggttacaaagggggatgaccgagagcctctatgagcctctttgaatgggggcctctacaacagcaaaccttttgtaagttaaaggaaaaacttatgttggccccagtcctaggactaccagatttgacaaagcccttttcactctatgtgtcagaaagagaaaaaatgtcagttggagttttaacccagactgtggggccctggccaaggccagtggcctatctctgaaaactactaggtggggtttccaaaggctggccaccatgtctaagggccctggcagcaacagccctttgaacacaagaagcagataaactaacccttgggcaaaacctgaatataaaggccctccatgctgtggtaactttgatgaatagcaaaggacatcattggctaacaaatgctagattaaccaagtaccaaagcttgctatgtgaaaatccccacataaccattgaagtctgtaacaccctaaatcccgccaccctgctcccagtatcagagagcccggtagagcataactgtgtagaggtgttggactcagtttattccagcagtcctgaccttcgggaccagccatgggcatcagtagactgggagttgtacgtggacgggagcagcttcatcaacccacaaggagaaagatgtgcaggatatgcggtggtaactttggatgctgtcattgaagccaaaccgttgccacagggcacttcagcccagaaggctgagctcattgctttaactcgggctctagagctcagtgaaggtaagactgtaaacatctacactgactctcactatgcctttctaaccctccaagtgcatggagcattatataagtaaaagggcctgttaaactctgggggaaaggacataaaatatcaacaagaaattctacaattactagaggcagtgtggaaacctcagaaggtggcagtcttgcactgcaggggacaccagcgagcctccatctcagtggccttaggaaactctcgagctgattcagaagctcaaaaagcagcgtctaccccttaccgggcattggtagcagcccccttactcccttaaacacctgacctggtacctacctattctaaggaagaaaaagactttttccatgcaggagggaggtaagtaataaaaggaggatggatcagactgccagatgggagagtagctgtgccgcagttgctgggagccacattcatattggccatgcacgaaaccacttatctaggtcaagagtcacttgaaaaattgttaggccagtacttctacatctcacacttgccagcccttgccaaagcagtagcacaacagtgcgttacttgccaacagcacaatgagaggcaaggccccagtgttccacctggcatacaagcttatggagtggctccttttgaggatcttcaggtggatttcacagaaatgccaaaatgtggaggtaacaagtatttgctggttcgtgtgtgtacttactctggatgggtggaggcttatccaacaccaactgaaaaggcctacgaggtaacccgtgtgcttctctgagatcttattcctaggtttgtactgcccttaagaatcgactcagataacgggctggcgtttgtggctgacttggtacagaagacagcaaaggcattaggaatcacttggaagctacatgccgcctaccaacttcagagttccagaaaggtggagcgaatgaatcagactatcaaaaatagtttagggaaagtatgccaggaaacaggattaaagtggatacaggcccttcctatggtattgtttaaaattagatgcactccttataagaaaacaggatactgcccttatgaaatactgtatcataggcctcctcctatactatggggacttctaggcactccctgagagttaggtggaattgaattacagtgtcagctacaggctttgggaaaaattacacagacaatctcaacttgggcaaatgagaggtgtcccatctgcttattctccccagttcaccctttctctccaagtgatcgcatgtggatcaaggactggaacgtagcccctttgcggccacggtggaaaggacctcagaccatcatcctgaccacccccacggctgcaaagatagaaggaatcccagcatggatccaccacagctgtgtgaaacctgcagccaatgaaacctgggaggcaaaaccgagcccggacaacccctgcaaagtgactctgaggaggacgacaagccctgttccagtcacacccagaagctgactggtctacgcatggctgaagcatgaggaggatcatcatgggactcattttccttataatttcaacttgtatagtaaaaccttccactgattttccccacatggaggactgctctcagtgtatacatcaggttacctaggtagggcaagaagttaaaacaatctttctgttctatagttactatgaatgcttaagaactttaaaaggaacatgtttatataatgacactcagtacaaggtatgtagcccagaaaacgactgaccagatgtgtgttatgacccctgtcagcttcccatgtccacagtttttgaaatgagattaaggactgaaggctggtggggactcataaatgatacaagtaaagtattagtcagaacagaggaaaaaggggtgcccaaacacataaccttgaaatttgatgcctgtgctgtcattaatagcagtaagttagaaaggggatgtggctgttttagttgggaaaaaggctatatgaccgaaaataagtacatttgtcatgaattaggactgtgtggaaatgaatgtggatactggtcttgcgtcatttgcgccacttggattaaaaaaaatgaaaaggatccagtccaccttcagaaaggaaaaaatggcccttcctatactaagggaaaatgtaaccccttagagctagtaataaccaatccccttgatccttgctggaaaaaaggggagcgtgtgaccttaggaatcgatggggccatactggatccttgactaaatatcttagttcgaggagaagtttacagacgctctcctgagccagtgtttccaactttctatgatgaactaaatgtgccagtaccagaaattccaggaaaaacaagaaatttgtttttgcaattagccgagcatgtagcccagtctctcaatgtcacttcatgttatgtatgtggaggaattgtaatgggagatcaatggccatgggaagcccgagaattagtacctacagacccagttcctgatgactttccaactcaaaagaatcaccctgataatttctgggtcctaaaagcctcaattattggacaatattgcatagctagagaaggaaaagaattcactcaccccataggacgacttagttgtctgggacagaaactgtataatggtaccacaaaaacagtcacttggtggagttcaaatcacacagagtactccatttagtaaattcccaaagttgcaaactgtgtggacccacccagagtcccaccgggactggacagcccccactggattatactggatatatgggcatagagcttacacaaaattacccgaccagtgggcaggtagttgtgttattgacactattaaaccatctttcttcccactgcccataaagacaggtgaactcctgggcttccctgtctatgcttcccatgaaaagagaagcatagctgtaggaaattggaaagatgatgaatggcccactcagagaatcatacactattatgggcctgctacttggacgcaagacggctcatggggatactggatccccatttacatgatcaaccaaatcatacggttacaagctgtcttagaaataatcactaataaaactgtcagagccttgactattctggcccggcaagaaactcagatgagaaattctatctatcaaaatagattggcttttgactacttgctagcagctgaaggaggcatctgtgggaaatttaaccttagtaattgctgtctacacatcgattatcaagggcaagtagttgaagacatagttagagatatgacaaaactggcacatgtgcccatgcaagtgtggcatggatttgatcctggggccatgtttggaaaatggttcccagtgctaggaggatttaaaactgttataataggagttataatagtaataggaacctgcttactgctcccttgtttgctaactgtacttcttcaaatgataaaaagcttcattgctatcttagttcaccaaaatgcttcagcacaagtgtactatatgaatcactatcgacgtgtcttgcaagaagacatgggtagcgagaatgaaagtgagaactcccactattaagtgagattctcaaagaaggggaataagggaggggatcacccctcatattgtcttatgcccagtttctgcctccaaagaaagaagtaaaaactaaaaggcagaaatgaaatccacaagcagacagcccagcaccacatcctgggcctggtagttaaagatcgacccctgacctaatcggttatgttatctatggattacagacattgtatagaaaagcactgtgaaaatccctgtcctgttctgttctgttctaattactggtgcatgcagccccgagtcatgtaccccctatttgctcaatcgatcacaaccctctcatgcagacccccttagagctgtgagcccttaaaagggacaggaattgctcactcagggagctcggctgttggagacgtgagtcttgccaaagctcctggccaaataaagcccttccttctttaactcagtgtctgagaggttttgtctgcaccttgtcctgctacagggatacagaaagttgtcacactggccttccatccttgcaaaaaggcagagggtccactgagctggttaacaggttaacctaagccgtccgcagatggcaaggctaaaggagcacactgtaacacatgcccacttgggcccctgcacctgtccatctgtgtgctccctctcctgtaaggggtttgagcagcagcagtgactgaacagatgagccacacacctgtcacatgtcctgtgaatgggggtcaggaaactgtccatttccctctcatgagagagtcccactctattccttgagggagaaaatgttgatgtcatgaagcttcaataaaaccccaagatgacaaggttcagggagcttccagagagctgaacacttgtaggttcctggagggtggtgctgcaggaagggcatggaagctctgtgcctgttcccctgccatcaagaagagtccaaatctgtaaaatatttgaagagatttattctgagccaaatatgtgtgaccatggcccgtgacacagccccaggatatcaacagaacatgtgcccaaggtggttgagatacagcttggttttatatattttagggaggcatgagacttcaatcaaataaatttaagaaacacattggtttcatctggaagagcgggatagctcaaagggggagaagaccttctgcgtcataggtagatttaaattttttctgattggcaatttgttgaaagagttattatcaataaaaagaaatgtctgggttaaaataaggggctgcggagacctaagttttatcatgcagatgaaacctccaagtagcagacttcagagagaatagattgtaaatgtttcttatcagatgtaaggtctgtctgtgttgatgttaaagctggagggatagaattaggcatgtccaacccccacttcccatcatggtctgaaatagtctttcgggttaaattttagagtcccctgacccaggagaaagtccattcagatgggtgggggggcctcagaattttatttttggttcccattcccaaatcttgccctacacatcctcatctgtatcctttgcaatatcgtttaaaataaaccagtaagtgtaattaagcatttccttgagttctgtgagctgctccagcaaattaattgaacccaaagaggggtttgcaggaaccccaactcgaaggtggtcagccagaagttctagaagcccggacttgtgactaatgtgtgtaggggggcagtcttgggaacagagccctcaccctgtgagttctgatgatctctatctttgggtagatggtgttggaaccgaattggaggacacctggatggtgtccactgcttggtgtttgggggaaaaccccccacacatttggtcacagaagtcttctgtgttgatgattttttgtggtgtgacagcagagggaagacacagtttgaggtgagtttttgcctatacgccattcatatgaggtatctaaaacagtcaaacttagagaagcaggaaacagaatggtcgttgctaggaaaggcgaggagagggaaaagggagatgttgatcgacagttcagttattggagatgagtaagttctagagatctgttgtacgtcacagtgcctagagttaacaataaggttttatgcactcttgagcaactccgaagaagtgactgatcatgcttttgaccttgcaaggaaaaattgtggtagaaagcaaaaatcccttgagatgcttttcaacaactcaagatgctatttaaaagctttgaacattaatagatagttgtaaagccttaaccttttacgagagtggttttatgtcttttaaatgaaaaggagcacacttcattgtattttagctgcgtttttgtcctgtagtagctgaatattcagaatctctcagattttcgtcatctggtgtgtagaagctggtagatttttttctctttatccttcatgtttctctttgatagtacagctgtgtagatataaaactcaaaaacgtttattttatttttttcccttaggtgggatttatcctctttaagacaacttcctgacctcggacacatagaaggctgctgaaggcaatggtggatcctttcatttcaaacaaaatcacattcaatttttttgagagctgcaggcctgggtggtgttaaattgtgtcatttagtattaaagaaacacgataaaactttcaaagactgatcatgtgtcttggctgtttactgtggaaaggtaggaaattggctacagcaaaagctattcatgtgaaaaataaggatttgaggcacctcagactaccacggagacagaacctatggtttaaattggtatttgtgtgtctatatttggaggcataaaaaaataaacagatgtggatttatcaaatgaacccaagcgaggccaggtcaaaggaaatttccaggagaaactccacacgttaaatttctctttctaatacaaaatgacaacacacttaaacaaagaacaggctgtgccaacatgggtattttatctctaaaggggagaaaaagtcttgataccattttctgtcttctctttatagttggtctctctatttgggctatagtaaaaataattattcaggagaaaatttcctttttctttctttctttctttctttctttctttctttcttttctttctgtcctttctttctttctttctttctttctttctttctttctttctttctttctctctctctctttctttctttcttcctttctttcttctttctttttctttctttttcttctttcttttgtcttccactgtcacccaagctggagtgcagtggtgtgatcatagctcactgcagccttgaactcctggcctcaagtgatcctcccatttcagcctcccaagtagctgggactacaggagtgcaccaccaagcctggctaatttttaaatctttttgtagagatggggtctccgtatgttgcccaggctggtctcaaactcctggcttcaagggatactcccacctgggtctcctaaagtgttgcagttgcaggcatcagcccaccatgccaggcaggagaaactttttataagagccaatatattgtgggttaggtattgcaataccatatactcacaatttccaagtctatatatgtcttggtttaaggagtaaaacgtagttaaagcacattcatcttgcatcagtacccgaaagtgattttaattggcaa[131 bp omitted]tctcagcctcccgagtagctgggactaaaggtgtgtgccaccacgcccagcgatttttttgtatgtttagtagagatcgggttt[132 bp omitted]acaatgtggggattaggggcactgacccccccactcagtcaaaaatccatgtattacttttaactcccccaaaacttaactgctaataaactgctgaagaccagaagccttatggtgacataaacagtcaactaacacatattttgtatgtatatgtattacatactgtgttgttacaataaagtaagctagagaaaaggaaatactattaagaaaaatcataaagaagaggaaatatatttaccattcatcaagtagaagtgcatcgtcataaatgtcttcatctcattgtcttcacgttgaggaggctgaggaggagaaggaggaggagaggttggtttctctatctaagggatggcagaggtggaagaaaattcatgtgtaagtagatccccaatgcagttcaaaggccaagtgtagatccttcttctaaagacaggtgtgcatcacctttacctggctgtcatagttcatccacacgggtgtgtaggctgggtctcagacttgatgctctcaagttaccactctctgttttgttctcttctatttttggaaagccaagtaaaatatggaaaagaagatctcatagatgattagtcaactctttcatggaaaaaatgctgtgaaactaattgtgtttcatagaaacatgccatattcttgtaggaactcaaatatttgtttacagtaacatatatctatacatgcacacacatacatgtataaaacctaaataggtcatctagtctaatttcttttttttgtaggtggctggacatctaagtttttcaggacagataacattttcttttcttttctttctttcttttttttttttaaaaaaaacttattccaggcagggcacggtgcttcacatctgtaatcccagcactttgggaggccaaggcaggagagttggctgaggccaggagtttgagaccagcctgggaaacatagggataacttgtctctacaaaaaacataaaaatcagctgagtgtggtggtgtgcacctgtagtcctagctactcaggaggctgaggtgggaggattgcttgcacctgggaggtggaggccacagtgagccatgatcacaccactacaccccagcctgggtgatagagtgaggctctgtctcaaaaacaaaagaaaacaaaaccaaaaacaaaaaaaacttattcctatacctgaagattgtgaaatcaatctttcttattagccttgcctaatatatcctgaatttgtaattatattgacttagaagtcattaaatagttccttaatcaaaaaaaccaaaacacccaaatactttctggacatgttttagcttcctgtttatttctccattttacacttaagataatgtattattctcttctttatgcaattaaaatattttgaaagtaattcagctaataatctttaaactcctcattttcaagctaaatacgtaaaaattctattactttttcttgaactttctttctaaggctggccttgtcatgcatgtgaaatctgaagtgtgggtgccaatgttgaccctagggtttggtttagtgatgaaaaagctcttgcttctcactaatgttaggtgacaaagggctatttgtaaccagacttccagcagtagaataaagctgagcacagccatgactcagaacacaaagtttttgttctgactttgcaatcccaaagtatgttctctttatgaggcctaaatgagcagaagaccaatttttttttttttttttttttttagtagagacagggtttcaccatgttggtcaggctggtctcaaactcctggcctcaagtgatctgcccaccttggcctcccaaagtgctaggattataggcatgagccaccacacccggccagaagtctaattttagaatacgtgattcaatttccagcttaaaaggaagagcttccagagatcctgatcaagatgaccaaataggaacagctctggtctgcagttcccagcaagatggacacagaaggcaggtgatttctgcatttccaactgaggtacctggttcatctcattgggactggttagacagtgggtgcagcccacggagggcgagctgaagcagggtggggcgtcgcctcacctgggaagcacaaggggtcagggaattttctcccctacccaagggaagttgtgagggaccaagcctgaggaaccggggtccagatactgtgcttgtcccatggtcttcgcaagtcgcaaaccaggaaataccctgaggtgcctaacccaccagggccctgggtttcaagcacaaaactgggtggccatttgggcagacaacgaactagctgcaggagtttttttgcttgtttgtttgtttgttttttccatactccagtggcagctggaacaccagcgagacagaaccacttactcccctggaaaggggtgctgaagccagggagccaaatggtctggtttggcgggtcccacccccatggagtccagcaaactaagatccactggcttgaaattcttgctgccagcacagcagcagtctgagatggacctgggacactcgagcttggtggggcgaggggcatccatcatttctgaggcttgagtaggcggttttacgctcacagtataaacaaagctgccaggaagttcaaactgggcggagcccactgcagctcagcaaggttgctgtggctggactgccagatttctcctctctgggcagggaacctctgaaaaaaaggcagcaaccccagtcagggacttatagataaaacccccatctccctgggacagaacacctggggggaaggggcagccatgggcacagcttcagcagactaaaatgtccctgcctgacagccctgaagagagcagcggaccaccaagcacagcattcgagctctgctaagggtcagactgcctcttcaagtgggtccttaaccccgtgtatcctgactgggtgacacctcccagtaggggccgacaggcatctcatacaggagggctctggctggcatgtgtcaggtgcccctctgggacgaagcttccagaggaaagaacaggcagcaatctttactgttctgcagcctctgctggtgatacccaagcaaataggattgggagtgaacctccagcaaactccagcagacctgcagcagaggggcctgactgttagaaggaaaactaacaaacagaaaggaatagcatgtccactcaaggaccccatctgaaggtcaccaacatcgaagaccaaaggtagataaatccacagagatggggagaaaccagtgcaaacaggctgcaaattgcagaaaccagaatgcctcttctccttcaaaggatcacaactcctcgccagcaagggaacaaaactggatggagaatgaatttgacgaattgacggaagtaggcttcagaagttgggtaataacaaactcctctgagctaaaggagcatgttctaacccaatgcaaggaagctaagaaccttgaaaaaaggttggaggaattgctaactagaataaccagcttagagaagaacataaatgacctgatggagctgaaaaacacagcacaagaacttcatgaagcatacacaagtaacaatagccaaatccatcaagtggaagaaaggatatcagtgattgaagatcaacttaatgaaataaagtgagaggacaagattagagaaaaaagaacaaaaaggaacgaacaaagcctccaagaaatatgggaaagaaagaagaaagaatgaatgaatgaacaaaagaaagaatgaaagaaagagaaaggaaagagggagggagggaggaaggaaggaaggaaggaaaatttactcatagatgagtgccttaacttttaaaataatactttcaaatcatgtgaatgtattaaatcttctagactattaaattaggtgttgccaaaaattcatatagaattacctgcatctctctgttttatgtttaaatagccgtctcctgctgtgaatttctccatcaagttatttattcagaaaagtacttaaaataggtacaaataagaggagaaaagaaagagttggtttattggctgcattggtgaaacaattggatgcagttttgacaaatgcattaaagaagaaatggtgcccctatgctgtgacaaaacgacctcagagaataccagcgtgacactacctgtggccacaatccttctccagcgcctccagggtggcagacgccagaaaaactcagatctaccttgtttgttcttttgaagttcaattctccactgatccttttctgtatgtatttttgacaaataacagagatggagaaatattttgagaggaaaataaacaataagcgtgtacctgtaaagggaaacccactcagttgtagtaacatttgatgctgctcagctctgtttgttttgagacagatccaattacagaagcaagaccacggggcaatgcactgtgcattttcagctttgagaaacgaagccaatgcaactcattgttttaaaccacaaagtgcctttctattaaaagtttaaaatgtagagaaatagaatgcattggctctgcaggatcttgcacagattctaagtggattacaagacccctcaagcctttgagagtattgtcagtaagtgcaccttcttgcaaggcagaggggaagcccatgaccaattaggaaggattgcctgtctgcaattcatccctccacacgctttcttgttatccccttcgaatccaactctggtcacacgtaatggtcatcattcattattaaaacagaagtctagggccaggctcagtggctcacacctgtaatcccagcactttgggaggccaaggtaggtgaatcacctgaggtcaggagttcgagaccagcctggccaatatggtgaaaccccgtctttactaaaactacaaatagttagccgggcatggtggtggccacctgtagtcccagctactcaggaggctgaggcaggagaatcacttgaacccgggagacggaggttgcagtgaaccaagattgtgccactgcactccagcctgggcgacagagtaagactccatctcaataagttcccatttacaggttcggagttgtaggatatgaatatgttttggggtcacaattcaacccattgaagttgtatccagttctttctggaggctgtagggaaggctccttccagaggaaactggttacaattgtagtggattgaactatatagtcccctcaaacgctatatctgcatcctagcccccagaacctgggaatgggaccttatttggaaatagggtctttgcagatgtcattaagggaagaatcttgagatcacaattcactgcagccttgaaactcccgggctcaagtgatgctccccactcagcttcctgagtagctgggattataggcgcacactacaatgtccagctaattttttgtagagatggggtctcgatatgttgcccaggctggttttgaactcctgggctcaagcaatctgcccgcctcagcctctcaaagtgctaggattacaggtgtgagccatggcacccagcctctgtaggtaaaattgcaacatgaaaatacgtattcaaatatagacaactattctttatgctaatgaagagaaatggagctgcagatgttaccgcatggttaattaaacattagtttgattttatctttattaatacttcaattaatgatttgttcctcatggaatattttccctttaatttaattaattttactttataagtaatatattttttttcattctctgaggaaacagctattaattagacaagagagggtcataggtatcctacacctggaaatgtgaagtgggggattctttggctataaagaaatagctgtttgtttaaaaaattattttcttttcccagtttttgtagagacagggtcctgtgatcttgcccaggctgatctcgaactcctggcttcaagcaatcctcccaccttagcctccaaagcactgagattacaggcatgagccacaaagaatagttgttttccttgtgaactgctcagtataaaacaggttcagctcaaaatatgaagttcttctggaaggaaattcgagaaactaagctgtatgtttatggtgtcttcccatcaaacaattaacaaggaaacaaaagacgatgtatttgaaataaaatatattttcaagtcttcatatattccttaactcttgagaggcaaagattactctgtgattggagtagaagaatttccctttccttcgtgacttctctggttttctaaggctgaagtaattcacagaagagaaatgatctctgaaggggaatattattgtggtttcctggaaggggttggtcacagaaaactccagcataacacctcatacatatggccagagcaatgaatacaaaggctataggcatcatcccatccccttaataagatgcattgattggacaaagatgatactggcacaagaaatgtctagctgcacttggggaagggttgatggtcatagtcagtgtctgtggaatgctttaactattaacagacactggcacccacttccaggaaggaaggaaggaaggaaactgcagagtgtctagggtacacagtgatgtttcagggattctaagctttagattttggggataattaaattgcatcagggagaatgaacaatgcctcctgtgtaaaggtgtaacgtccacctgagggccaagtgttgtggcttacacctgtaatcccaatgctttgggaggtcgaggcaggaggatagcttcagaccagcagttcaagaccagactgggcaacataaccagaccccatccctacaaaaaattaaaagccttagctgccacatggtgtggtggcatgtgtctttagtcccagctatttgggaggctgaggtgggaggatcacttgagcccaagagtacaagggtgcagtgagctatgcctgctgcactgcactttagcctgggtgacagtgtgagaccctgcctctaaaaaaatccacataaataggtaatattataaaataacttatagatcacaactagagtatcaattaggcacaatggagataatgacattaaggttccctcctgaggactgctttactttcctgttttgactgttcaagttgttttggtcattaagtctacctcattagggatgtagagtcgaatgattatgtgttaaagacccatggattatttatcctctgtgtggttaagacctgtatgcaaaattaggttcatttgtttcattttactttgttttaagcattgtttttttaaaaaaatgaaatttatttttaaaaattttgagggaatggtacattcacattcagtggtaggaaatgatacatagaggttgcctgtaccttccatcctaattcccaaatggtaacattttgcataactgttgtacactgtcacaaccagaaaagggacactgatacaatccactgaccttattccatcagtttcactgataataatttttatgtgtttgtgtgtctttatgtctttacagttttactacttagaggctcatataattaccattacaatcaagaaacagggcagtcgcattacaagggtctctcattttgccttttgataaccaacccccaacatcctcctgtatttttaattgcattctattatttacttttcaaaatagccacacaccccgacattgtggttttacaggcaaaacaaatagcagaattaactcctctttaatttgaatccaagtaacttatttcccagttttacttggtctatcttatatattgttaagtagtctatgttcagtagagtccaggaagtattagttcagtattttttttttttttgagacagggtcttgctctgtcacccaggctggagtgcaatgacatggtcagagcttactgcatcttcaaactcctgagcttaagtgatcctcctgcttcagcctcccaagtagctgagaccacaggcatgcaacaccacggccggctaattttgaaattttcagtagagaataggtattgctatattgaccaggctagtcttgaactcctagcctcaagcaatcctcccaccttggcccccaaagtgctgggactacaggcgtgagccattgtgcccagcctattcagtatttttgtgtaccgatactttacagggaattgtggaagacaggtttaagaaaccaaagaacttaaaatacatctgagaaaataaaactagcttatatgaaactaaatattttggtattatggggccaatcatgactatcaatagcaataaaaagcattatccatatcacatatctatgggctatgttccaatcttgtcatgcagttgaaacataatttacttatttatgtcctatttcttttataccatcatttctcagtctccatggaaaattggttctaggactcctcatgaatatcaaaatttgaggatgctcaagtttcttttataaaatgacatgatatttgcatataacctatgcacattgtcttgtatactttaagtcatctctagattccttaaaagaccaaacgcaatgtaaaagctactgtgttgtttagggattaatgacaagaaaaagaaaagtctatacatattcattacagacccttttttttttctgaagatttttgatccctggttggtcgaattcacagatatggaacccatggatacaaagggctgactatacatcaggtatggttgaacttgaggcaatgagcgacagatgtcagaaggaataagatggaaaggcaataaatagaaaataaattctggtctgttttttctctgatccactacaatggaaaccagcctcactagtgtaagaatagtacaaatgaatattcatagaaatctttaaaatgtttacaaatcacctctgtgtcaatttgtgatttaatcttttttagagaaatatagatatattttacttaaagttctggggtacatgtgcagaacatgcaggtttgttgcacaggtatgcatgtgccatggtggtttgctgcacctaggaacccgtcatctaggttttaagccctgcatacattagctatttgtcctaatgctctccctccccttgccccccaccccctgacaggcctcagtgtgtgatgttcccctccctgtgtccatgtgttctcattgttcaactcccacttatgagtgagaacatggggcgtttggttttctgttcctgtgttcgtttgctgagaatgatggcttccagcttcatccatgtccctgcaaaagacataaactcattcttttttatggctgcatggtattccatgttgtgtatgtgccacattttctttatccagtctatcatcattgatgggcatttgggttggttccaagtctttgctattgtaaatagtggtgcaataaacttatgtgtgcatgcgtctttacagtaaagtgatttataatcctttgagtctatacccagtaatgggattgctaggtcaaatggtatttccggttctagatccttgaggaatcaccacactgtcttccacaatggttgaactaatttatgctcccaccaacagtgtaaaaacctccagcaccatttagatcttaatttcaaatggcaagcaggtaggctgccaacttagaggagagcattgccaggggatatggtactactttcggaataggattaaaacagaaaaatgcagtacagcaaaatttggctacccctgctcccagagtggaagtgtttatatcttcatgcagcaacacggaatcacagtgctataaaacatagagtgcttgattcacacgttctgcacagagtgtgagggtgtttatcacaattagactgatcactggggaaggagtgaggaattgcgtgggatgccgtaaaacccattcacatcctgcccccatagggaagcagtgtcaacaatgtaaacacatcagagaccttgctggatgcattttgggatattgagtgtaatcccttgaacatggtgtacatctgacatgaaaatctggaagctacctcccagcagaaggatgcattaccatttggcaaatgtggttgtttttccctgcaccctcacccctgacttttcatcatctagctgaggaagcatttcttctctttttcccttacttatttcaattcccaatcatgtcaatgatcccaggccaagtggaaacaataaaaggtcagtggaagaagtaagaatataaaagaatataaagacgaactgctgcttggggattgatggttgtccttgtagggatagtgatctctgttctctagctctttgaaagaaaaacacccattatcacttgccagttggctaagagggattttctttctgtgggttcccttgagcatatcatcaatgtgtagaaaataaacacaaagggaaaacatttccttttttgttgttgaatttggagtcagggtcttactctgtcacccaggttggagtgcagtggtgcaatcatggcttactgcagccccagcctcctaggctgaagtgatcctcccatctcagcctcttgagtagctgggattacaggtgtgcaccattatgcctggctattttatttttccctgtagagatggcgcccaggctggtctcgaactcctggcctcaagcgatcctcccacctcggcctcaagatgctgagattataggcatgagacgctgcacctgccggagaaaacatttcctaaaatagactcatgaagcacctagaatacctggttcactccttttgtcatagcctaatgtcaccttagctactgtttctgctgaaagaaagttgtgagccaaagccctgttctgtatttgtgagagagatggtggtagcaactgagggcattgctgttgatatgcccttcagaaagaagatggctctctgagtaagggatttgctgatagttcatgagtagcgtaggtatcaaccaggattgaaaccatggagctgtccaaggtcctactctccatccactgtaaaaaccccacccagggtctccaaaacattcctaggataggagatatggcatgagggattccacctgtaagcccacaaatggactagcatttggaagacttcacatcttccttctatcccaagatactgaaatggaatatgatagttttgtcctcagagtgcaacacagagtgatgaaagacacaaatgccctattagttggggaaaatctgaaagattttacgaagtacacaaagcttgaaatgagtgtagaagtatcaccaggattttacttttttttgttaataacgctttctcttctctaagaaattgtattcttttttgtttttgttttaaatttcaactttttagatgcagggagtacatatgcagatttgttacatgggaatattgagtgatgctgaggtttggagtaaggatcccgataccctggtagtgagcatggtacctgataagttgttttttcatttccgccccccagtcacactctagtattccacagtatctattttttccatagttatgttaatgtgtgctcaatgcttacttcccacttataagaaagaacatgcagtatttggttttctgttcctgcattaattcgcttaggaaaatagcttccagctgtatctatgttgctgcaaagggcatgatttcattctttttttatggctgtgtagtattccatgacgtatatgtaccatattttttaatccaatctaccattgatgggtacctgggctggttccatgtctttgttattgtgaatattgcagcaatgaacatacaaatgcatgtgtgtttttggtagaatgatttattttcttttgggtagatacccagtaatggaattgcctagttgaatggtagctctgttttaacatctttgagaaatccccaaactgctttccacagtggctgaactaatttgcattcacactaacattgtataagcattctcttttcaccatcgcctcaccagcatctgttgctttttgactttttgataatagccatcctgactggtgtgagatggcatctcattgtggtttttgatttgcgtttctctaatgtttagtgatgccaagcatttttttcatatgtttgttgtccacttgtatgtcttctttggagaagtgtctgttcatgtcctttgcacatttttaaatggagttatttgttttgtgcttcttgatttaaattccctatagattctggatattaggtctttgttggaggcatagtttgtgaatatcttctcccattctgtaggatgatggctagaattttgactgataaaaaagtagatatatttttggcaaagcaagaaatacatgaagttaggatctgttaaattatagctatgttctagaaaatggcataaatagatagtaacattagtagaacatctttagttcacatttttttcttttcttaaatattagcaacgtttcttgaatatttactgttgattggaaatgacatgagtatttttaaaatgcattaattccttctcttattattttttgtcatatgtatttgtgttcttttttattatttttaatttttattcattttgaaatcactttagatttacaaaaaagttacaaaaatggcacagagaattctagtattccctttgcacagcgtcccctaacattggtgtttcaaataactacaggaaaactattgaaaccaggaaattaacactgttgtcacactgtcaactaatccatagacgttcagatttctctgattgtcccgctaatgtggtttttctgttttaatgtccttccaggacccaccttgcattcactatcatgcctccacagtggacttccatctgggccatgtccttagtttttgtctctgatgaccttgaacttttggaaggatacagaccagttattttgcagaatagcatccaattcatcttcgtctgatgtttacccatcagattaggttgaggttacacatatttggctggaataccacagaggcgatgttgaggtcttctcagagcatcataccaatgatgtagatatgtttcattattggtgataactttgattatctggttaaatgtggtaccttctcagctgcttcattgaagccactattttctcatttgcaactagtaggtaccctgcggttactttgagactatgcaagtatcttgtttctcctcatatagctaactgtttcttttagcctctgagggcaactcttgcctgaaataatgattatgattttctggttccaccattccttctgcatttatccattggaagtctactttcatggagaggtttatcttctttctcattcatttatccattcaattaattactcgcatcaccatggactaaggaataattttatgagtataatttctaactattagtatttattttcttgttccagttttcccagattaggacattgggagctcttccaagctcccaacgtgtctttccttctctacattcttttttaaaaaatgagataaatataagtgttatttatacctggttgaatttacacaattaaaaaaagatacacaatcaatgtatgtattttggggatacatgtgataatttaaatcattctatcataaaggcacatgcacgtgaatgttcattgcagtactattcacagtggcaaagacatggaatcaagccaaattcccattaatggtggagtggataatgaaaatgtggtacatatacatcatggaatattatgcagccataaaaaatgagctaaaagatgagaacacatggacacatagaggagaacaatacacactggggtctacttgagagtggaaggttgggggagggagagggtcaggaaaaataattaatgtgtactaggcttaatacttgggtgataaaataatccatgtaacaaacccccatgacacgagtctaccggaataacgaacctgtgcaggtaccccggaacttaaaagttaaaaagaaaacgataccttctctacattcttaaaaataatacaacattgcttaacctgtttctctttgtggctgtgattacaaagtgagaagactgaagtaggtgtcattatagcaacagtctttgtggcacctaagggctgtttcagcaaacccgaatgctttcagacctcattgttttaataattttttggatgactgtgttccctctttctcctcattcttttcttagtcattaaatttcacgactgtcaagcctccccaccatagttcatctttgttctgattttatgtgttattgcctgataaaggtgtgaggctaacagccccatttcctccaaggtaaaagtcataggcttgtgatagattgcttggaccactcctgcttttttctgtcctttgcctgtatttggttgtgccccatcatatcagacacccggccaaaatagagttctcctctataggatacttcctttctggtttctgccttttcaataacatgagatatgtagacaacgtgtcacttagagagttatatgccagcattgcacacacaaatcatttaatcagaactaaaaagagtggaagtaacagtgattgtatcatgaatagaaagcaagcagaaagtttctgctagattaaaaaaaggcaaaagagcttagacacctattccagcagtaatgttctacagtacttgaaaatatgatgctttactgaatgcgcccataaacagcacagagctacatggtatttgtaagcagacctttggatgggataaaaataatctctcacctaccccaggtggtgaaggaaacatctcaaatagcaattgtaatctgctaggccacagtggagggaagaaattaggtatgtgcctaggcaggatgacctttcttgctttctgtaccatgctacatatctcctaccaatgcagtgaggaaaatatttgcaatatctatattattattatataaagataaataatatttatattgtttattataataattaatcaataattattttactaactctgattacatatttacataattatacaatgtatggaatacatatagaatatatagaataggatatatatgataatctatagaatagaatatattataatacatagagaatagtatatacattccctattagaattctattagaatagaatttatgtgaaaatacatataatagaatatattagaatatattatattatgtataatacattattagatagaatatattagaatattctatattattatattatcatataatataatatattctatattatattattatataatataatatattctatattatattattatataatataatatattctatattatattattatataatataatatattctatattatattattatataatataatatattctatattatattattatataatataatatattctatattatattattatataatataatatattctatattatattattatataatatattctatattatattattatataatatattctatattatattattatataatatattctatattatattattatataatatattctatattattatataatatattctatattattatataatatattctatattatattattatataatatattctatattattatataatatattctatattatattattatataatatattctatattatattattatataatatattctatattatattattatataatatattctatattattatataatatattctatattatattattatataatatattctatattattatataatatattctatattattatataatatattctatattattatataatatattctatattattatataatatattctatattattatataatatattctatattatattattatataatataatatattctatattatattattatataatataatatattctagattatattattctgtaacatatattctctattatattattatataatatatattctctattatattattatataatatatattctctattatattattatataatatatattctatattatattattatataatatatattctatattatattattatataatatatattctatattatattattatataatatatattctatattatattattatataatatatattctatattatattataatatatattctatattatattataatataatatatattctatattatattataatatatattctatattatattataatataatatatattctatattatattataatataatatatattctatattatattataatatatattctatattatattataatataatatatattctatattatattataatatatattctatattatattataatataatatatattctatattatattattatataatatatattctatatattatatattctatattatatcctatattctatataatatataatatattctatattctatataatatattctatataatatataatatattctatattctatataatatattctatattctatataatatataatatattctatattctatataatatataatatattctatattctaatatataatatattctatatattatattctatattctatataatatattctatatattatattctatattctatataatatattctatatattatattctatattctatataatatataatatattctatataatatataatatattctatattctatataatatataatatattctatatattatattctatattctatataatatataatatattctatacattatattctatattctatataatatataatatgttctatatattatattctgtattctatataatatattctatatattgtattatataatatatagaatattctatatattacattatataatatatagaatattctatatattatattatatatagaatattctatatcatataataatatagaatattctatatcatataataatatagaatattctatatcatataataatatagaatattctatatcatataataatatagaatattctatattatatatattctatattatataataatatatatattctatattatataatatagaatattatataatacattctattagaatgttatataatatataacacatattatattctattatatactgatatataaaaataagtatacaaagtataaaaatattggctgggcatggtggctcatgcctgtaatcccagcactttgggaggccaaggcatgcgaatcacgaggtcaggagctcgagaccagcctggccaacatggtgaaacaccatctctacgaaaaatacaaaaattagctgggtgtggtggcacgtgcctgtagtcctagctacttaggaggctgaggcaggaga[152 bp omitted]aatgtatattacatatgaaataaaattttatatacaatatgcattatacatattttaatatattatatattttatataatatacattgtatatttttgttatattacatattttatatataatatacattatatactttaaatatatagtatatattaaaatacatagtatatatatttaatatattatatattttaaatatatattatatattaaaatacatggtatgtatatttaatatatatttaatatataatatatatttaatgtctatattatttaaatagatatctatataaaatcagccttaaatggatatctatataaaatcagacagcctccagaacatggacctatagcatacccttaggaagggattaggacaatctctttttttaaatttaattttattttagattcaggggttacatgtgtaggtttgttacatgggtatattgcctaatgatgggggatttgggcttctagtgtatccattacccaaatagtgaacattgtacctaataggtaatttttcaactcttgcccccctctaaccctacccctttttggagtccccagtgtctattgttttcatctttatgtccatgagtacccaatgtttagctcttacttatgagtgagaacatgcaatatttgactttctgtttctgagttagttcacttatgataacggcttccagctgcatccatgttgctacaaaggacatgattttgttcttctttgtggctgcatagtattccatgttgtagatgtaccacattttctataccccatccactgttgatggacacttaggttgattccatatcgttgccattgtgaatagtgctgcgttgaacatggggtgcaggtatctgtttgatatactgatttcccttcctttagagaaatacccagtagtgggattactattttagctatttgagaaatctccatactgttttccacagaggtagtacgaatttatattcccaccaacagtgtataaatgttcccttttctctgtgtccatgctaacattggttgttttttgaatttttaataatagccatactgactggtgtgcgatggtatctcattgtggttttaatttgcatttctgcaaatgatgatgattagtgatgtcgagcatttttcatatatttgttggccgcttgcttgtcttcatttgagaaatgtctgttcatgtcttgggatgagggcaatttcctgagagcaggattttgtttaccaaatagttgtcctactgatttcttattgcaaggctcctggctaaacccagagtggatataaattattgacaatcacacccttcgtaaattaggaaaccaaatttcaaaccaaatttggaagagtttgttgatctcagagtgttctgagacccagaatttaacaccttagacagtgcccaagtagatggtgtgaccttccactaagatggtcattagatgcatggaaaacactatggtttacactgagtggagcagaaatatcagcactgctgtggcagatggtagtagatgggaacaaaacctcagagaagctgatgtgctgtcatggaagagctacctgatatttctgttccatagcaaggaaaacaaaatgcatcagggcaaggatgcatgaaggtaatgacaaagagctggtgagaggatggcaacatcactcagcggttcagaggtggtgttctcttggaccaggcctgagaggaggagaagcagtaataacatttgtcttgctgataacaaaggagatgataagacctgaaatcatagagaccctgtggacatttttatctgcctgtagtgagtcggtcagatatatctcaatgactagcaacatcatagtgtcagttgaggggtgctatgaaacaagagatgctctttggtggcaagcaaataagttctctttttcactaggagaaggcaaaaaagctaagaccacctcaaggatccaacagtacaactggctgaacttcaaagaaaattaaatgccccaatcaaagcccatctctaagaccaaggtcagggcactggttatgaagacttgggattctggcccatgggatagagacatttgggtgaattgcctgcccagacttgcctgaaatttctgagcctgcataaggagccaatttcaccagtaagagctggatgtccctctgtgatagaagacaaggtagaggttgcttccccacaaggcaacaggtgccccctcaggctgtgtctctgcttctccttttgatcttcagggcacacatcatgaagatcagagggccacatgcatgaagatcagacaggcatggacatgtgtgtggagcaaattgtgtggatatctaacagaagaatttttcagcatatgccagtgaaaggaatcatgatagaaaacaaagaggctgagaacaggcactcttttccacaatagccacaagcccttttttgttcccaggtctgagcttgttttcaagactagaacctaatagttgaagagatactggggtccctgggaagacaccctgccattaaaaagacaaaagaaatcggatcattggaagatcacatcaaattattatattgatgacagcagattgatcaggcaggatgtgcaagaggtggtcaccatactgggaaccttggtgtaaaatgttttgtggagtgtgtaaggattcaggggtctcctatatcaggaaaaaaattttaggctttcaggtgtcctatctgaggtagaaaacaaatagttgcttcttgtatatctcaccatgtaaaaggcagcacaaaacccggtagcccttttttgggttttggaaataacacagaaacagaggttgtaatcttatgccttgacccatgtactgggtgacaaagaaggtggccagtttatggggactcacagtagaaaagagctctgaaattgtccagtctttgatgaaaataaccctgtcacgtaggtaaaataatctggcaaaccctatggtgttggaggtgtcagtggagggaaaggatggtacatagagtccttggcaagccatgttgggagagtcacaatacaggtgtctagggttgttgagcaaggcctcaccattctcaggagagatatgcattatttgaattagtttgctcaagcttccttaatggaggacagcataaactgtccaccttctttgtcacccaatgagtatctaccagaagacgttattcctacatctgaagtcatactggtgagtgttatcttcaccctagtcattcttgcttcttcacccatcttcgtatgtcaaacacacacacacacacacacacacacacacacacacacactctcacacaccctatagacattaaattaaatgccccaactctctaccccttaagcattctgttaccatctattcaccaacattttgttccctcacaggatgactctaatatgaagggatgatggagaatcttgacagaccatggtggaggtgaccagaggtagccacagatgcagaggtagtgtgagagtagggcaataataagactgtggggtattagcaatgctgtagtccatggtatttggcaataaatcctggtacctggattactgtaccaaccagatggctctagcactgattttggctgtggctcagctatttgttgatcttaattcctctcccttttcatggcaattttttgagctatcggtatttctcaactggggtgatttttctcctgaggggacatttgacaatatctgaagacttttttgtttgtcacaactggtcgggtaggaagaaaaagtgttctattgtcctcttctggataaatgtcctataatgcatagaacagcctcttacaataaagaattgtgtagcccaaatatcaatagtgttgacgttcaggaaccctgttctttattatttcatccatgcctttcagcttaaattagctagagttggttttgactgattgctacaatggccatgatggatgcaggtaatttacacttgaacgtcatttgcatttaagggtgctatttaaccctgaatgtaaaagtgtatgtctcaagtgttctccaaagtttaagaaaggatccctaagttatgacttgcttctcctgctgttcacaataacacaataaaacctgtaaaagcttcacctactttttgtccttctacacctgtcctaccttggaggatgcattgggagttttaactatacttaaaaagttgcagagccctggtccatggaccagagaaaatgcttgtggagcagattcccacacacagcatcaatgttgattaattgaacatttataatcagcagagaacccagcactgttaaaacagctcatcaattagtgcaaccaatcacctggtcattggtgagataaagtcttggtccagtgaatgataaggatgtattgacacgcattgtaattgctatttgttgtcttttttggtcaataggagtcatctgtgcttggaagtttattgcagttctgatgttgaaggacattatgccaagagactgcacggagagccttgtgtactgcccttgtctagatatgtgctaccaggaagtccaagaagttaatgccttgtggcaccaatctttaactaatagaagaagcaagtgaataatttattgctgctttcttccgttccaaaggtgcaattccaaggcatgttgtatgcatcttagtggcgttttcctgcaggttggccaactagcagcacccagggccatcagtgcatagattctcccacatgttttgtcttactcttcttgctccttactcctatctctgggttcgaacccctaataatggatttgtatgtacacatccactgcatttaatgctgctgtctggggaaaagcagatctatatccctgtaatctctatctgggcacactcagtaaatgtccactgtttccctcaaaccagaaacagtgagccataattgacatttctctttccctctcacctctcaaaacatctgatttagcctccaatttctgttgggtttgtcttgatctctcttgagttgattccattctttatgtttccacagccattgatttatgtccatacaaacattacattgccataattgctactatagaatcccagagctggaacccaattctattcttggttgtcattataacgcatttctgagattgagagacaccatcttcttatgcctacagtgaccagtcatcttcagttgctcaggtctaaggtgttctgaggatgtgggcattcagttctaaaactaaagagccccaggaaaaccaagataagctggtcactctttcttaggaagcctacaatggcttctatgaatgttagagtgagcgtcaaatttcttagtcttgccaccaaaactttcagcttactttctgacttcacctgtggacatattttcatgactcattttgcttcaagaattaaaattcttgtgttttctcaaacaggtcacacttaactgcctggttcttcactactctgaatgccttttcccacattttcaccaataaaatgactccttccatgaaagattttaagttgatggagaagtttaggggctcctattataaccattgcatagatatattttatcctttatccattttagactaatctttgacccgtgtttcatccactccttttagatggtgagtttcttgaaagcagggactcaactttttcaattagtatggtttgagtgtttttgtgtcttccaaaattcatgtcgaaagttaatccacaatgcaatagtattaagaggcagggcctgtagaggtgatgaggtcatgaaggctctgccctcacaaatgggattagtgctcttataaaagggcttgagggagtcatcttggccctttttgcccttcttccatttaagaacacagtgttcctctcttcttggatgtgagaatgcagaaagaaggcaccatcttggaagcagagagtgaaatcgcatcagaaactgaatctgcttgcacctggagcttggacttcacaacctacacaaccttcacaaccctagaactctgagaaataaatttcttttatttataaataaggtattttgttatagcagctgaaacagactgaaaccctaactttgaatattttatgttattatgcatggtatattgtaaagtatatcgcatgatgatataaatatgttatagtatgtgatgatatagtgggtttgtgttctgtcttctgtacaagaatttatataactcatctgtgtaaagttcttggcaataaaaccctcagtgaggattttataattggattaaataatgccaccagccttcaggaagtggcctaaccatttctaggccttctgtgaagaagaaactcaagaataatcgagggaatgagagaaagaatgttttctcctttcagaaattctcaaacacactagtgtgttctgagaaatcaaaatttgcatctaattcacaaaataaagagcaatgtggttgttcccatacttgcaattctctatttcattctcctcttggtaagtccaacctattttgggtaggctctgagcaacttgagacctgttgtctctccactgggcaagtcttttcacatatattgagatttattttcttgaagctatatgaggggattggagcctgaattatattttgcaaaatagttctggtgacaatttatttagtgagaactgtcatagggtggcctaaatgtatgcttttaaggaataatcacaaaaagcataactcaatatttacacacatttctgcacagtgttgatggcataaccacgttaaataatcgttttgtcatgtaaatgctatcaccttcccaaaatcaacagcatattatgtattatgctgatgtaaactggagatcaaagactggtctgtgggtcattccaaaacagttaccctcaccagtggtccaacatgggcttctagttgtcaaattcatctgctaaaacataaaaaaatacataccatcctgcatttcacattacctacctgcatcttgtatgaaggcaaactccttgtgcctttttctggcagcctgtgaaacctttaaatatggcgtgaaatgatttggctctgtatcccaccccaaatctcatgtctaattgtaatccccagtgttggaggaggggcctggtgggaggtgattagagcatgggggtggaatttccccttgctgttctcatgacagtgtgtgagttctcaaaagatctcattgtttaaaattgtgtgacaccttccccttttcttcttctttcttttctagccatgaaagatgtgcctgtgtccccttcatcttccaccgcaattgtaagattcctgacgccctctcagctatgctttctgtatggtctgtggaaccatgagccaattaaaccttctttttaaaaataaattgcccagtcctaggtatttctttataacaatgtgagaatagactaatatatggtgggaaggcacatactttcagactccagggaaaggacccagataaaacctgtggcaatccccagtgtttcttgcaagactgattcagacattatctcatataacatacatgacaggggagagagagagatgaaaaaagagttttgttcattcaattggactcctgtgacttcattaattatatgtagtatgtggatataatgattcattcttattttccaatgaagcaatggggaggcacatttactccatccatcactcttcctagtctccattacatccttcttctagggaagaatttgtcttaaacttttacttgccattatccataccattcactcttttattgacggccatggagaccattaggcacaaatgacatctatcgggaagttgtcatccacatttggctgtttttctgcctcactaattttttaagacacttttcagtagattaatggatccaaaccctcatttcaattatttttattatgcctggctactgcttgcccccattaaaatgagagtgtgcagttcatttaaggattcaatattcccgttaagcagtaattcacactggtttctttattaccactccaccaactcatgggatttttttgatttatagatgtacttgctgttggaactcagcctctgtctgctgaactctgtgtgtatcatgggaactttccctcgaaacgcttaataattactaatgaagttttctccagtttgtttagctgcatccactgtgattatcagagtgaactcaaggcaaaatgagaaattttaatgcatttctatgggattaattttttgcttgccatggtaccaacagcagccagttcctaccaataggattggcacagtcaaccgctgacataggttccatgaatttggactttcaattgtgatctagtttcctggaagttttggtaatatttttgctctttttacttaatgagcaatttctgagcaaaggtagtatcatttggaaaatatttattgggggatataagtgatagtcacatcaaatgtatatcaattttctatgctatgtaatcaatgactacagacacagctgcttaaaacattcacttattaataaatactcatttattagctcacagttttgcaggtcagaacaccagcatggtgtggatggattctctggtcatggtctcacaaagctaaaatcaaagtgttgactaggctgaatttttacccagaagttttggggaaatatgcacctccaagctcaatttttttattggaaaatctcagttccttgtggttgtaggactggggtccctgtgtttttgctggctgtctgtccacagtctttttaagatagtctcctcaatccctaagccaataacaacacattaaatgctggtcatacttcacatctccaacttcctattttgctattagccagagaaaattgctttcaaatgctcatggctcaactgcatagtgtctctatctttagattaattgatttgggactttaattacatctgcaaaataccttcaccacagcatctacattagtgtttgattggataatctgtgtgtatgtcaggaggcaggaatcttaggagccattttttaatccttcttaccgcacttggtattattttcttgggacttcccaggtcaaattgttcaagagcctaatgacttatttattctcaagagtttatttctgttgtttcaaaaatattaattgaaagcaaaattggagagaatctgccactcctgcagctgatattgctgatgctcccattgaagaaaaagtagcaactgaactgagtgtaggacaaaatattaatattcttctgcaaaaatgaacactcaggagccattgaaaacctgattccctgggatgcacacggaagagtttatatttaaagtaaataagacaatactgggtttatattatatttaagtccaaacttcagacaggcttcttggggaggatcgctgtgtggttataatctcattgtccagttattggggtcatatctggataaagcagctgacattcagattcacttgggtccacactgttcacagtcagcactcggggtcctcattgggagactttgtagagtttagattaggtaatggatgtgtgtgcctcactgacagaattcattcttgctactataatgtgtggttcttttttttttctttgctagagccaccatctggggacttactggaagccttataaatggtcatagtatcttgcacaacattgcttctaaccaaggaacccatgctagataatgggttattgcagatgagaatcactgatcttgttgtgtgatacccaacacccagaaacaactggccttatagaataatagaatgacctaatatacttcactcgtacctccagttaaataaatgctttcaatataaagtgctgcctgtaagattaagaatattctttgaaccaggtcaatatatgatgcagttcttcttttagctagaataaatgagtcagggaactaagtaatagaatagaagatggaacatctccagatactcaacaacctccttctacaatttttgcttcatgtccccgttgtatagaaaacttaatatccaataaaggaattctagcaccaagagattaatagtcttgctgaatttggagcttaggctagcagctggtcattgcaactcatgaggtcattgggtagacaggcacacaatagaattttgcttttagccagtacgcccaacacatgcattcattcatgaccaatggccacacctatctcttttccagctgccactgtggtgaccagctttgcatgtgctcgggctgaaatgcggggttcttggaaactgattcagctgagtccatatgatgcttgcccactcctggtcttttatttatcaaattcaggaaagaacactagttttaaataaggaaaacatgccccaggtaatacctttctgctcctctccacatcaaagacattggctgaattttacaaaacaattctgtgaccacaaggaattgtttatgtaggcaacataggtatcttttctctgttaataaatattgaatggatatattttaattttaagtactaataacataatataatgctataatttatttatgattctatttataagtgatgccaatctttaaaaaataaccgatggccaacagatgtcctctgtcttctttcacccattctaagacagtaattttgtacctgatctcatttggatctcaaactatgcttaaagagccttatttttatgctataggaaaaaaaaaaaaggccgggagctgtggcttaagcctgaaatcgtagcactttgggaggccgagtcgggcagattacctgagctcaggagtttgagaccagcctgggcaacatggtgaaagcccgtctctactaaaacacaaaaaattaaccaggtgtggcggcatgcgcctgtagtcccagttactcgggaggctgagtcaggagaattgcttgaacctagaaggcagaggttgcagtgagctgagattgcgccactgcactccagcctgggtgatagagtgagactgtgtcgccaaaaaaaaaaaaaaaaaaaaaaaaaaaaaaagaaaagaaacaaatttagatgcataaaagggctccatagccaattgttatgacatattgtaatacatagctaccatttcaaacacactacttatacaccaggaacttgccccatgcacagtatcccatgttattaatgcaattacagtctctaacagaaatgaaattattctcattttacaaaggaagaaatagcaccccagagagcgctgagcccctaaaagtaaactctaaccagaatgatactgaagtatagtaagaaaaaagaggaattacccttctccaatgggtatgtcaattctatttcagggttttgtaaccttggcatggttgatattttggtttagtctaagcttgtccaacccactttattttgttgtttttctgttctgttttgttttaggcttttagcagcctgaagccatggattttagtttctgtctctggtgataagtggaaaagagagataaggaaggggctttactggcccagccagaaacagaaactaaaaacccatgactgtaaattctcccttggacacccctggactctacactctgaccattctctcctgtgggagctctcaagtgcgccacaggctgggagtatatggtaggagactgagcagagcagtatccctggcctcataccttaggtgtcagttccaactcctcaattgtaacaaccagacacgtcttcagatattgccaaatgtcccccagtgggtagagttatcccttttgagggccactgctctgtataaaaaccacaaaacttggaaattatctaaaatatgtagttgcaatatccattgccctaactccacaataatgtacactaaaaatgctagatcaatatgacacccaagtcaaagaatatgagtcctccatgacattcaaacaaagattaggctccagaaaagtatctcttctgatgacactcatagccctccttagaagtgaaaaaaagctcaaattttgtcatgtcctccagcactgatagagctcaaaccttgaaaataaatcctctacttcttaaagggcgctatttcctggctcctaaagcccaggagaatggcctcagtaccacaaatctatgaaatcctgaaatattgtagaagccctcttattgtaattccattaagaaaccactttctctcactcaaaaactaccagaaatatacaatgcccagtattcactttagtttttgaaaactcatgctagaagacaaaattctaaagaaagatacttagattaaatgatgcttgggtgccatgtcaatctggtgttttcagagtagattgtcttggagtgagggggttagatattgcaaagggaattagattaaacatttcaaaatatgcaaaagtggtaaatatgtctttcaaaccataggcataatttaccagagaggcagtgttctttattctactggtgagttttaagctttactttagcattcattgtttcctctactcaactcagtgataagcttgttgagggtagaaagcccacaggttaaacttatgttactctctattagtcagggttccccagagaaacaaaaccaaaatgttggaaggataaacagacagacagacagacagatagatagataaaataactagttagctagatgataggtagacagatgatacatagatgatagatggatatatagatgatagatatatgatatatatatatagagagagagagaaagagagagagagagaggaagagagataaagagagaatagagatttattataggaattagctgagaagtcccatggcctgccacctgaaagctggagacccaggaagctggtggtgtacttcagtctgtgtctaaaggcctgagaaccaggcatggctgctggtattaagtcctggaatctgagaacctgacaaccaagagctctgagtccaagggcaagagaaaatggatgtcccagctcaataacagagtgaatttgtctttcttcaacttttttgctcccattcaggccctcaatggattgaattatacccacctacataggtaagggtatcttctttcttcagtctactgattcgacttctaatctctcttggaatgttctcacaaaaacacctagaaatagtgtttaccagctatctgggcatctctgagcccagtcaagttgacacatgaaatcatccatcacatccacactgggtaggacacacacatggaggaaatgtctgtctgtggcttccaatagaacatgacaatatcattggaacatgttgcaatgacagttactccttgatattcctgcattgttaagagttttgtagtatctcttagggataccttcaattctatcttccttgagcagatgtttatctttatttcttactcatagacaaaatcatctaagatcaggaaaattctctttcttgctgaatgtagccacacagttaagatgctgcaggtttttacaaacaaccatttgtaatggaaatatttccatggtgtcagttaatatgcagatatcattgtaattaataatccattatcatgaaactgtgtggcccagctggaggtctggaatggaaccagagtagtggtttattctgaatgtaatattttgatggcatctacctgtttctgtataaattacactttcctcaggattgcaagtgttctgctacccatgaagttctctggaaaacataaattttcaggaggttttgttaatcttatttttgcttcttgaaacattttttgccaggttgaatgatggagggtatcatattttaccactgtgttctaccagatttagatttttcatgagccatacaaagagaggaaattattatatcatgcagatagtggccctaattcatttaggcatctatcaacaaaacatttttgagttgtggtggtaaatttttaccactatcagagagacaagaattaatgggaaatctatgaaaaaatggctaataacaagcatagacaacagatgatatttcttttcttttttgcccttcctttcttcttttttgccccctccctccctcctccctccttccttcctcccctccttccttccttctccttcctgctcctccttccccatttcatttttctgacatccactatgtgcttgacatatacttggcaccacaggaaaataaacaagataagcaaaacaatttttaacttcatagaagagaattaaaggtaaagacaggatcattattattctgattgttgtattagttaatccattttattgtgtctcatttgaggatctaatttaaaaatactgcaaatgtcatcaattcctgattagaaatggtgccctctaagtggacaaactggctttatcaaataactttacactcttatcaaatgtatccacaatcttatcaaattaatctacactcttcgtgtgaggtttttcaactatttgcattatcgttcaaatcggatttatttacaatgcctgcaagaatattaaaaaccctggaaaatgcccagaaatataagtctatatacactatgtttttatctgcattgtatgatttggtcattaaaatttagttgctacatattcatgaataggaaaattattatatgtctactcagtcagtttttcacctcaaaccttcccaatgggatcaaaacaacaaaatagtataaataaaaatgaatgtatttgattttctcccccaaaatattttgggttttaaggtatgaatttatgattttatataattttacactgtgtttgaaagagtactttcttgtaccttagttcagcaagtcattagaaaaacagcagtaacatctcaatgctccataaaaatctgggaaaaagctatatttttgtgaattcgatttcaactgtgtaggtggaatacagtggagattgctacctttaatttctcagaatcagataacatctatagtcaacagacatttcctgatgtcatctttgtttgccagtggcactattttatgtttatattattatttctctgcaccaataagacaaagactcttgggatgtgggtaaaaaggtccttagacccttaaactccaggttcatcttgaaaatttagtctgtagtcaacttcagagagtgaactcgttgacctccaggggcttccctatgtgggcagctcattggcatctgcattggctacagttgaagatttttttcctcttttaaaaatgttatcaaggtacattatattgttagacttaatgatactgaacgagctgtttacatttttaaggaagaatgtttaattattttaatttctttatttgatatttgtctggtcaaagttttatttcatatatcttaatttataaagttaaaaacatcataatgaatgatattttaatgaatattaaattatcttaatgttttattttatatgtttctggaagtaatgtaatttgtccaaacttttaaatactttggaacagagttcacaatgttcttgtctaatctttacaatctccactgaatctttgattatttacttttctgggcttaatattatttatatctctctctcttctctctcttttgctctctttctattcacatcatgtttcttttcctctctcctactctcctttaaagtggtttgtctagttcatgatattttccccaaagaatcaaaatcaaatattggtatgctttgcttattccaatttcttatggatttttaattctgaaaacacacacactagatcattacttttgatgtacaacttcatacagaaaagtgaacagtattaagtttacaatggaataaaggtttatatttttatacatttttacatacacatacacctgtgtcttcaccacctgtatcaagatataaaatattcccagaagtccagaaaactcctccctgttttcagtcagtactctcacaatgtttagccctgttctgacatctatcaccaccatagatattgttttggaactttgtgtaaatagaatttcatactataaactctaatatatctgattctcttcagttgatggtatggctgtgagattcatacatgccgtgctataagcagcagctcattgctttgatcgatgtgtatagaattacatttactattcattttctttcgcattttgacaagtggctctctccaattttacctcttgatttgagtacttattatatttgttttcatttttgagatattcattttggcctagatatttatttctaggaatttcaatagctgtatgtgccatgttttggggtgtagattctttgagtctcacagcaactgccaggaacatgaggtagcgtcttagttcatttgtgttgctataaaggaatacttgaggctgagtaacttatttaaaaaaaaagaggttgatttggctcacatttctgcaggctgcacaggaagcatggcaccagcatctgcattggatgagggcttcaggctgtatccactcatggtaaaagaagaagaggagatactattactgaatttggtacagagcccattgagaggatttggttaacagatgcatacctgcctgctatagcttagatatttggccctccaaacctcacgttgaaattgttccccagtgttagaggtggggcctggtgggagacgtttgggtcatgggagcgaattcttcaaaaatggcttggtgctatcctcataataatgagctctcattctgttagttcctgcaagagctggttgttaaaagagcctggcatctacctcctctctctcttgcttcctctctcactatgtgctctgcacttgcttgctcccctccccttctgccatgtgtggacacttcctaagaccctcaccagaagcagacactggcgctatgcttcttgtgcagcctgtagaagtgagagccgaataaacttcttttctttgtaaattatgcagtctcttgtatttctctacagcacgaatggactaagacactgccttaagttcctggagattgttttgaggctcacagaagaatttggaaaaacattttgctaactgtaaagtattccatgcatgtgaataacactgtttattaccacagacaaatggagggtttataaaattttgggtaacagatatgaaaataaaaataaattaggatcaatactaattttcttcaaaatttctgacatgacaaatttatgtataaatattgcatttgtgtgtgtgtgtgtatatatatatatgcatatatatgtgtatgtatgttttttttttttttgctaaactatgcaattgtacccgccaacatttctagattcagaaatggtgagacctcatctgtagattcagtgtgacccttttctgggcagtggtttactgagcaaggtgaacacccagaattgcacagttagctgagggacaaggagtagtggttattaaaatgtcaatttctatgcatcttttaatctaaattgttaaagaaattatggttattaacacctaacatggacatataaattaatgcacacactatgtcctgagcaattttaaaacattgttcattcatccacattttattcttttggacattctggtttgggtgtaagcttgctagcatgcacaatctatttgacccaaagcacagggatctttctataagtaaaataacattcaactattgggctgatgctccaattttgatagagtttgtgaagaaaagacttcaaggccatggatctagtttagcatggagcatagaagggtgaattcccaggatccatccctcctcttccatatggactgttagctcctgactcctccgaatctaactttaaataaagacagcagagtttaaatacaggactgcctatcacaggactgccctgccaatatttttatagttttgaaatgcaccactcaagctatgcactactcaatgcaccttcctgaaaggtgaaaaatgtaaatgaccatgagtttgaaatgacaactcccagaaaggtcaaaccaaacagttttctgtgaaaaacaatttacatagcaaatgatgcattaaatgatgattcgacttttcattgatgataatcatagcataataagaataatctctccaaaagtagacttgttctgagcatgaacatagcctgtacatgcaaatttgcattaaaaaatataaatgtatataagtgtacacttggttaggataggtgcaaatattcctgcgagattcattttggggtttatttaactaacaaaatctaacagatggttttgccgcagtctgtgtttcatctacatcacggaaatttattgcgttgtcatttgatttttcatcgcatgatttggtaaccatgatggctttctggcactttcatcagtgaagtgagtggtggttaagagccagtaagaccttaagagtcagtaaaacccaataagatctggcttcgactaactgtgcaaacttagaaattttactaaacctttctgagctctagtctattacctggaaatgggaaaacaaagttcccaatttattgttgtgcaaataaactaaaagtgcatggcctagcataaggtaaatgcatatagaactttgagttgtatattctacttagcatttaaatttatgatgctgacttatatgatcagaaataaatgtcctctctgccagtatatcttaagtttccttacccatgattttgatcctagcagtgtagacaaatataattaaacattacattaaaatttgttaggaattataggactgctctatcccaaaaaggatgctgtttagggcatattgtcaaggataggaactaaaacttgagagctgaccttcattctttcaggttatcagaatcctaacagcaagtgtgcaaactgcaagtgtgcaaatacagagactcataaagcatagttaaagaaatggtaggaagtgaacctttataatttaatcaatattcaatacacatcttgatgtttgatgtgatcaggcatggggtgtttagattatcaatcaagatgagtgccaaagatcattcaactattgatccagaacagagatggggaggtttggagctggggtggttactaatggtgaggaaggtctgtgtctaggagagaaacagatttgccagtgtgtttaccatcaatgcaaaacactagagggaatgaggccagaaacgtgattcttcctgggcttggagaaagtaaaatgcattagcctccttttccttcttcaattatttaagtttttattagaataagaaagcatgctacatatgccttgtatttatttatttttatttttataaatgtatgggggtacaagtgcaattttattacatgcatggattgcatgggggtgaagtgagggcttttagggtatcaatcatccgaatgatgtacattgcacccattaaataatttctcatcacccaccctctccaaccctcccacccttctgagtctccagtgcctattaatccgctctctatgtccatgtgcacacattacctagctcccacttataagtgagaacatgcagtatttgtctttctgtgtctgagttgtttcacttaagataatgccttcctgttccatccatgtagctgcaaaagacgtgtttgcattcttttttacggctgtgtagtattccatggtgtatatgtaccacattttctttatccaatcctccactcatggacacttgggttgattccatatctttgctattgtgaatagcgctatgacaagcatatgagtgcaggtatctttttgatagaataacttattttcctttgggtagatacccagtagtgggattgctggatcaaatagtagtgctatttttagttctctgagaaatttccatactgttttccatagacattgtattaatttacattcttgccagcagtgcataagcattcctttttctgtgaatattcaccaaaatgtgttatttttgactttttaatagtagccattaggactggggcaagatgatatctcattgtggttttgatttgcatttctctgatgattagtggtgttgaacgtattttcatatgcctgttggccatttgcatgtcttcttttggaaaatgtcttttgcccactttttaataaaattgtttttgttgctgttgttgttgttgttgttgttgtttgtatattgtattagtctgttttcatgctgctgataaaggcatacccgagactgggcaatttacaaaagaaacaggtttaattggacttatagttctacgtggctggggaagcctcacaatcatggcagaaggcaaggaagagcaagtcacatcttacatggatggcagcaggcaaagagagacagcttatgcaggggaatttctttttttaaaagaaatttaaaagcatcagatcttgtgagacttattcactgtcacgagaacagcacgggaaacacttatccccatgattcaattacctccctccaggtccttcccacaatacgtggaaattcaagatgagatttgggtggtgacacagccaaatcatatcatatattttgaatattagctccttgtctaagtttttaggtccttaattctccacctgaagttgtggacgatgagctcatggaaataaaatacttgacttgctgccttcttctttatcctggatgaaagggaaaattctaccaccattcacattactcagaaaagctgggttctggtggagaaaggcagctttttctggcacttggaagtaagtatcatttcctccgcttcattttagagcaatatttttatttttcattccctctcgaggaacaccagatgctgcaatttgaaactagtgattttttccccatggatagctttaagcagcattgcagatatggttcataggttcaggatcaaggatctggtagattcttgggctttggtttcttaaatgccattcatgaaggcaagagattcgggaaaagaacagaccaaaggtagagtgagaatggctcctactgcagacagatgctcaacttagaaagaccgaaatcgtcttttccatgcccacttctggtagggttaaaattgcctggaagaaaatgctgaatttctgtctgtactaaggaaacaatgacagcaaagctggtgatgtgagttaaaaaaagagaatgcaagaagaaaaggacaaattaggtgagctttgaatgatggatcagatgggacactactgggacactgattactaggatcaccctctaattcttgcagggcatggagattttgcattctgtttagaaaggtggtctccaacctgtggggctaccttgtcaggatgcattaagacttggagattacagctccagagagtaaacaatgaatcactcttccccatgatggctttgaaagaattgggggttaccacctgtgcatggtgtccgtctctgcagaaggatggtatgagtctgagtttgattcactcgcagtgatgctaccagccagccagccagaggcataactgcagggttgagacagtagagtatcctacattttaagatgcagcctgacagggagattttacctgacggtggtacccatcagagtgagctctcagcatttccataagcaaactgttgctgttggctcaaagcctgcatggtaggattgcctatcaataagatagcattgggcttatggaaacccacaaatatcttttaggatttgagacagtcctggctatgagctgcctctcgaaaatggccccattgagattagatcatactgaatgctcttggtggagaataagaagctggtgggttatcagaggaggaacttactttgatttacactcaaggaaacctgaaaagctgctggagtgtacagctgttagtctccaccgtggctggcttaggcagttccagtttgtgctcatctccctggctatcttgacagtttccagagaagtgcatcctttaatttttacagtgttgtatctggctacagcaccttatcaatccaaacaccttgggcaggtgtttttgttgtaaagtcaatccgtacttgtgacccagtgacatgtcatacataggaggcaactcactacatgggaaggggcagattgtgttgcaaagatcagttgagattattttcccaaaagagaaataaacagatttgaatttatgccattgtggagttttatattttctatgatattattaccaatatatttttaggagctttataaactactgttgctgtattccttgggtaatattttcaagctcttctaaaatgcatcagtgaaagatgaaacaaaatgctgcatatggaaactgtgaaagcagtcggggagaaatctatatttcttttaagttaggcctcagttgcgcagacttgttcttaatgtcagatgcaaataattattattatattgtattatttacacattataccctatacatttatacataagtatattgatatattttactataatatacattattataattgtcagttattttaatgtctcttgaatagaataattatattttctattacattacatatttttaacataacaacttttgtgtatgctgcagtttactccttttatatatcataagtataacttatttgtaataaataagttgtgcagctatttcatgatatcatattaattcatatatatttacatattaattaatcattttatagtatgttgtatttgtatattatgcatttataaattatcatgcttttattatattgtgttagttttatattgtcatgaatatcacttattcttattgctacttgcaaataattcttaatatatattatattatatattatatactatattaattataatcattggcatatataatatattataattaatatatactatattaattataattattagaatatattatatattgtgatatatgttatataatatatactaataattataattatatacactaataattgtaattatatactaatatatatgaataattgttatactatattaactgtaattaatatagtatataatattaactttgcatatcttatattgattattatgcattttactcatctattatgtatgatattattatgtatcacttattctttattatatatactatttcatattatgtatgatattattatgagtatcacctgttctccataagtcatttgcaacgagttgtatagttactctgtgataatatactatttaattactttatattaaagtagtttgtagtcacagaagtctagtgaaaaggccccagtcactatattgtcaacccctaatgcagttgtaaaaagtgactctatcaacgtgaatgatcctgactagcgagctttttaataactcaccttcaagagctaacctttggacagtgaataaacatgtcctacatgtaatgtccgttgctaatataggtaaattttcagagcaaggaaactccattcagcagggtgacgtcttccagtcctctgcaccatcctcatgacggagtcctggagaaagcccagggtgtagtcaattcccaagtgtcatcttggtctctactctcaccctccctggtcttctccttataattcctcaaaagcgctttctctgcataggaaaaaatcaagctctctctctctctctgaacaggagactttctttgccgaattttcctctctttctgtctttgcagagttaaattttattcttcctatagaactaaccacaaagtacgatcttgactcctcagacctgggctaggtcctctctctgtgttcttatcgtgtagtcttaattttccttcatcttttcccttgcagttggtaatcctatggttatgtgtgtgattatattctaggagtgaacctccagggctcaactgtaagctccaaagaagcatagatgatatctctatttgcttggcctttgtctttacaccctgggtattcagtagaaatctactaaaaagagtgagtgaggaatgtgttggtttcaagtgacggaaagggaaatatgacattgtccctgctgtggtggaatgtgtcctcatcttatcccctggaacctcagatgggatctcatttggagagagagagggtctttggaaaggtaattaaataaaagatcttgagaagaagtcattctggattagagtgagtcctaaatgcaaagataagtgtccttctaaaagaaaagaggagacacagtcacagaggaaaggccacgttgagactgaggcagagacatcagctttgcggccacaagcccatggatgcctggagcccccaggtgctgggagaggcaggaaggatcctcctttagagcctctggagggagcacagccctgcctacaccttgatctcagactcctacttccagaactaaaaatgagtaaactttgttgtgttaagccacgccatttgtgataatttgttatagcacaatcagaaactgctatactatcccaaggaatgtaattgatgaagaaataacacgtttctttctccgtattcttctcctcagaatagtaagtaaggctaaggaggaattgaaggagcagcaagcaagctatttggtctattgaagaaatcaattgagctgtcactattgaaactgtattctttattttgttgttattgttttgttttttgagatagggtctcacactgttgcccaggctggagtgcagtggcaccatcacagctcaatgcagccctgattttctgctgggctcaagccatcctcctgcctcagtctcccaagtagctggaattgcaagtgtgcaccaacatgctgagctaatttttgcatttttggtagagacggggtttctccatgtggtccaggctggtcttgaactcctgagctcaagtgatctacccaccttggtctcccaaagtgctgggatgataggtgtgagccactgttcccagccttaaactgtattctgagatcagttctactttgggccagttatttattaaaacatctttcatgtggcactccgcctttcaatataatgattacctactgatatggtttggctgtgtctccacccaaatctcatcttgaattgtagttcccctaattcccatttgttgtgagagggacccagtgggagatcattaaatcatgggagcagtttccctcatactgttctcatggtagtgaataagtctcatgagatctggtgattttataaggggtttccccttttgcttggttcccattctctcttgcctgctgccatgtaagacgtgcctttgctcctcctttgctttctgccatgattgtgaggcctccccagtcatgtgaaactgtgagttctttaaatctctttttctttataaattacccaatcacaggtatgtctttattagcagagtgagaacagactaatacacctacttcatattcctcgtctttattctatgacctagtttaaaaaattatttatttatttatctatttttatttactgacgggtgagctgcctatagacaggactgagtctcagtgattttagcattgtcaacaatacatccagtgcttggcttctaacaagtcttcaaaattgtcagataaatgcccctgtgccggtgtggccagtcaaacactgtggatttttctgacatccttttatgaggttctgacactaagtcctgcaaatcaactgccttagacttggacactgaagtcccacaacttgtttgtttttggttagtagggaaggggtgccccggttgagatccaagcacttctttgtccttcctctttgattctaattttaaatgataccctggaaaatcaatattcatatttctcttctgttctctctctttccttttttatcttttagctatcatcagttttacaaagcctcattgctaaattttattagatacttactttttaacattgcctgcaggagttctttatgaaagatgacaataaagcacgtgtgtcctggagaaacatcaatgcaataaaatgccccactaggtttgatggccccaatagcttgtagggagaacagtcccttgaaggagttgtactttgatattcttaaacaatggaagagaatctcttccgaggggcactgatggccttaaaaatcatggaagccactaagtttacataataaactcttgcaaaccagatggttttatgattgtgttttgccaacagctgttttgaataagatataattgaggttcttggcagggatactcttcaaagggtcggattagctcaaagttaactcaattgcatcccccgggctacataagtaaagccttccaatttcaatcagttacaatacaaagttatcttcaaatgttcacatagacagtactttggagggctcattggtttggagtacagatattattttgaaactaggagttaggagcaaagaactcagtggaaaaaaaaacagatgagctcgaatggtcttggggtcactcatgccttccaactgttcagtcttggaattcaatgagtaacttctaaaaacctagatagtttcaagtggacttctgtggcagctgtaggttccacacgcttgggtagttcttatttgcaagtaggcatgggtatagttaagggtgaatgcaggagattttgcgtggtccaaccctccatgggccaaagaaaggacttgaacagcttctgtgtgataacctatgagccaaggtatatcctctgtgatgagggtctggggccatgccaggtagtttgtactaacaacatgattgaaggtgaatccatatatttttgttttcctgaggtggtgggccatgctgtattagtttgacctctgggcgagcaaactggggcattaataaccaaggtaaggcttgcaagtgcttcacaactataagtctgcctcccttgtaagaactctagacaccaagactccagtgaccctctctccttgacatcattctattcatgttgtctcacactgttgctggaagaattcagtgctgtccttctgactctgctggaagacaaggactggaaactcttgtctgggctctcctgaactttgccatatgtaccttttacctttgcaaatttgtgaaacatttaactatatttatttattttgcaatactatcatgaagttctacattcaattatttttgaaaaattcttttttttctagcttaattgtggtataattaacaaagttgtgtaattttttttttttgagacagggtctggttctgtcacccaggctagagtgcagtggcgcaatcttggttcactgcaacctccacctcccgggctcaagtgatcttcccaccttagcctctcaagtaactggggctacaggtgcaagccaccatgcctggctggctaatttttatattttttcttgagacaaggttttgccatgttgcccatgctagtctcaaacacctgggctcaaggaatccacctgcctcagcctcctaaggtgtataaatttaaggtgtgtgatgtgatgatttgatatattctaacagatacatgaaaaggtgctcaacatcactaaccaatagggaaatgcaaatctaaaccacaaagataccacctcacacctgttaggatgactatcaaaaagaatacaagatgtaacaaagatgtggagaaaagggaatcttgaagtactgtttgtagaactgtagactgatacaatcattgtggaaatgagtaaggagatatttctgcagaatttagtctgctttctttccccataataagttaccaccatgagggtcacagcttctccgagttctatgggtcttcctagcaaatcgtggaatcggagggcagatttggggaccttggacacatcatgccaaagagagaatttgggggaatttctggggtgaccaaacagaagttaaaggaaatataatgtgctgctttgtgcatacttctattttcatttttcttttctcttttcttttctttttcccttcccttttccctttccctttccctttccctttcccttccctccctccctctctccctcccttctcccttcccttccctccttcccttccctctttcccttccctccttcccttcttccctttattcccttctttcccttcttcccttccttccctccttcctttccttcttccctcccctcccctctcctctcctcccctcgcctctcctctcctcccctcccttccccatccatcccctccccttccctcccctctcctctctttccctttcttcagagacaaggtctcattctgtggcccagtctgaagtacagtgctgcaatcatagctcactgcagccttgaactcctgggcttcagtgatcctcccacctcagccccctacctaatttttgtattttttatttgtagagatgggtgcccaggctggtttagtactcttgagctcaagtgatccctctgccttggcctcccaaaatgctgggattacaggtgtgagtcattgtgcccagcctattttcatttcttaataagtggtgagaacagtctttgtggacaatattaatacacacaaagtcctttgaacagtactatggcattgtgcctttcctggggcagaacaagaagcaaattgagatagatgaaatgaaactgaagcatgcagatgacacatatacctagaaaatggaacattattttccatcagacagaatgaaccaggagcctcagctgacaaaagtcagcctctggcacaggtgcatgtgtgtctctatacattgctacatgtgcacctatttattcacgcaaatgtatgcagcatctacaggtgtcagaactggagttcagctgtgagcaaattggtcatctagtgtctccacgttgtatgatatgctgtagggtgttagcaagttgacctagagcctataagggatatgtaagtgtttccagacatcaacagggcaagtatacatgaaaagggattataggatgagaattctcaggatctaagttagcaaggaggagaggaagtttctaagaaaggacatttccagcagatgaaactgcaatatataaagttctaagctaaagattagagattgtggggaccaacaaacttaaaacagaactactattggaccaggcaatcccattactgggtttataaccaaaggaaaagaaatcattctaccaaaaagacacatgtagtcgtatgtttattgtagccctattcacaacagcagagacaaggaatcaacctaggagcccatcaatggtggattggataaaaaaaatgttacacatatacaccacagaatactatgcagccacaaagaagaatgaaatcatgtcctttgcagcaacatggatgcagctggaggccattatcctaactgaattaatgcaggaacagaaaatcaaataccacgtttctcacttataaatgggagctaaacaatgggtactcatagacataaagatggaaacaatagacactgaggactcctagagtggggaaagaaggaggggggtcatgggctgaaaaactacctattgagtgctatctatgctcactacctggatgatggggtcattcacaccccaaacctcagcatcatgcaatatacacaggtaacaaacctgcatatggacccccaaatctaaaagttgaaattatgtatatttaaaaatgattagagattgttgggatgtatggggcaaaggagagttttcccttagcccttgaaaggtttactgaaaaaccaacttgcgagaggcagattaattggataaaaattttattaacatgtatacagaggagcctttagaatgaagacataaagatacaggggaagctgtccatttttatgctttgcttcaacaaagtatgggcagccatgtagagatagggttggacaaaaagggcctgatccaatgctaacggactgagtggaaacccaaccaggcctgtctgtctagattcttcttgcctctctgagcagcgctccttccttctgggtgtgcggcgggaccctctctggagtgggggttcttaggacctacagtcaaacgaggtaggtcagggaatttctttatggccagtctttatgcagataggatagagggaaagttaacttccaatttttaggttttatggctcacgttggggaaaaagggttctggtttctgtgacccgccttgggaaagagggattctagtttctgtggtgcctcgggggaggatgggactgagaggcagttggcaggagatggtcagagagaaacgttggcttctgaggctgctgtggagacctgcgttgtggggtattgttttctgagcccaacagggagctgcaagtgcatatggtatcaatggatgtgaactcacatttctagatatgcctatggcattgcaacctagttccggggtctgcatcataaccagagaccctatgcaataaaacagtgtgtcttttactctctaaaaaataaaataaataaaatatctttaaaaagcaaagcagagctcatgctgaaaaggcttcccgaaatcatgaaggcacccaccaacattttctagactctaggttgtctcgccctttgcctgattattccaactcatgcaaccacttagcagagactgagctttcaaagtttgggtgcattccacttgctttgttagatggcttcacagtgctttacggagttggtgttcccatgcagaggctgccttaaaaacaatctgtcaaacggagacttcaagaagctgggcctggaataatacctccactctatttgctgacatttcaagcattaaattaatattcttgaagtcaattcatcaggctcctagcctgtaattgggattcaatgcatgcagtcgattagaggagagagcagccggtccatggagaaagaaggtttttcattttgcatccaatcagggaaagcaaacacaatcaggcagcgtttcgggggccgatagatactgcaattctaatgatgagggaagcaaacaggaggagacattggagtccctgaaacttctgtcttagtatgtcccccaatttctatcacactgaccccaatctggcttttaataaatctttatctttgaaacgcttcgttgtggagcaaatggaaagagtgtttgctccatcaaaagagcaaaagcacagtgtcgtgggagtgtgaaaccctgcatagcaatggaaaaaacaaaaacaaaaaccaaaaacaaggcagtgtttgtttccagtggatatgcatgctcacgattagggctgccaggttacagagttcacattttagatattgcagagctagagactgttaaaatattcgagactgctaatgctgtggttcaagctgcatccacatttttcatgcttaaggtggtctctagctcaatggattttcttgcattgattctgtaagagaaaggtggagaagtgggaaggaaggcccatctaggagaatagcaatatatattccaggaagggacctgtgacctgtctaaaatagcttcctagaactctagcaaaattgcaaagtccagtccagagtacggtccacatataatttcttgctggctgagatgcgcaggttgctggtagctgctcttcaggacatcattatctgtctaataatcaaaagaaagccagcaaaatggaactcattatacattagaaaaaaaaccacggctcgctgtggacaactttccttttggaaatatttgtccaagtacttcagaacatccagaactctggctgagcaaatccactcaaaaacgaagtcctggtggctccattgtcaataatccatgctaatgctttttgggggactttgcagcctctgcagcctctgcagagacagacacacaagagctcaagaaaaggattgtgatcctgggccttaccgcttcccaggtgcttgttatagggtggtttaaaaagcaagccagacaaggatatggtgtacctgtaggacaaaaacctaatagcccatctgtcatctctcttttttaaaagtgttgttggttcttcctaacagtcacccatctgttcttggaaagtccctctcctttaaaaatgatttttaaaatccagtagtgtatatacttgtttgaagaatttaagtaagaatgtggattgatgcacttagcactcaaaagttccccaatttaagatttacaaaaaaggatgagtgaaggatgctgaaaaatggctttgcaggaggagagtggaaggcttggggattactttatttttcttccaacatataatgctcttagagaggtttatgaaaaaagaaataaatgaaagattaaagttattgagaaaatgtggaaggattcatgatttggaaagcaggaatatgtcagaaaaatagacaacctaagttttatttgtaaaaaagtggagaataaagccagatgaaatgatggcatcttccagaggaaaaggacaaaaaaaaaaaaaaacaaaaccaactcatgtcaatggatgtaaaacatatgttggcataaatatgaaaatgtagcctacttactcattattgctgttaaggagatttccattttttagcataaaaataccttatctacagatacaaaatttctaccacagcaaatggagaagaggcccctttaaggaaaaaacctttctcatttggcaagttgagcaaaagcttgcacatttatatttaaacacaagcctgaggatattgcaggaaagaaagaaactctacaagtcatgttataaagatgacatcactctgtataacattccgctctataaaaaggcactgtgtatagatgtcatctctcatttaccatcttcaaggagtttaaaggtttaaaaatgatctctaaggtgtgcattaacacaaactcttcagcattttatctggtgagtaatgataataactaaaacattcaaggttactcactatcggcctagaatctggagttgatgcaaatcccttaatttgatttctggggtaaattatatgtaacatgaaatttaccattttaaccatttttaagtgtacacttcactggcattaagtacattcacgttgcgtaaccatcaccaccatccacctccagaatggcttcatctttccaaactgaaaccctgtccccattaaacactaactccctatccctcttcctccaaccctggcacccaccatcctactttctttatctatgggtttgacaactccagggatgttgtataagtgagactacacagtatttgaccatttatgactggctaattgcactcagtgtgatgtcctcaaggttcatccatgccatagcaggtgtcagaatttccttccttcttagggttgaaaaatattcccttgcatgaacacatcacattttgtttatccattcatttggtgatgggcacttggtttgcttccatcttttgattactgtgaatgaattgggtgtacaaatagctcttcgagtccctgtttgagattatttgcaaatctccttattctttttctaaaagtaaatgagcaggtgacagatagaacatgctgtagcttcccataaaagatttttgcaacatttaatggagaatggcccagcatctcatgaaggagattctcaaacaaaacacaatctggcgaacagattccatgggcttagcttagagggatgcctttaaaccctcgtgctttgcaactgctcttacctaaggttgcttgttgtctgtgactagctctttaactttaaagctttattaagaaagtggcctctgtgactcttgagtttatgagcgtttagtctcctttggttccctgctggccatgatgcactgggaaaaatgttcaggaaaataaatatccactcttctgcagaatggaatcatctcttcgaggtcagatttttctgagtttttgttatttaggagaaatgctgaatatgtaatactagcacacttaaaaaagttatgtgttgttcatggtacacttactcctcaaaagcaaacatggattaccaatgggacttactgaattaatagatatatgagaagctgggggagaaaaggcaaaatacagataaaatttcaatagtggctttgtgccaagcatgtttgtactacactttaactgatattccctcaagtggtccatggcagacttctaggcagagttatttctctatctatctatctatctatctatctatctatctatctatctatctaatctgttatctatctcttttatctacctatcatatatctatcttcatcatcatgttattttacctttctatctcatctatcaatctacgtatgtcttcattatgaatcttatctagctctctattatttatctatctctatcatctatctttattatcataatcttctatgtatactatctctctatttctgccaattatctatcatgtatcttatcaatctcatctatatattctgtcatctatgtatgtatgtatctatcatcgtgtatgtatcctaatatgtttctatgttatctatcttcatctctattatttacctatcatctatctctgttcatcatcattataatcttctatgtatactatctctttctatcaatcatgtatctatcaggtattttagctgtctattctgtcataatatgtatgtatctatatatcatcatcaggtatctattctactatctatatatccatctatctatgtatccatctacccatctgttaatattatccatcacatgtatctctcttatatctacctagcctatctatcaatcatctgttctatctacctatcatctatctatctctctatctatccatctatctatctatctatcatctatctacttatctatttaatttatccatgtatctatcatctatttatctattatctatctatctatctatctatctatctatctatctatctatctataatctatatttcacctctctctgctttaccgtgtgaagagctccttgcccactgtcatattcagggttctctagcctgtgacagctggatttgaatccagctccacttgtcactggaacattctaacatataagcaagtctttattccttataaagaagagtatgcccctctattgctgggatgtaaaacacccatgctctactgttgcatgtgaggctgtcagcatcaatatatatcttcaggggtgccactgttgtcatcttttatttacataaacaaataattcgaacttgtcaaccaatgttctcttctctgcctagttccttttaaaatcacatctttgctagatgcctgacaaagagaaaccccaatgtgcaggtgcagggtgtgcttcctctgcaatccaaaaagaatgaatgagaaagaaatagcacacccagggttcatgtggctcttagaacacaccgaaagagaggtggtgggaaattagtcagaagctctttgccccattttctgatgtgcacatttaagcatatgtttgtgtggataaatgattcctgtgcacaaaagacatacccaaattagttattgggagaagtgaagacaaaactctctgaattccttgaagtttgggatttacaattgcattttaaaaataatggattataatataaggaacttcccattaatttttaaaatttcattgtcataatgatccagtgaggttggaatcatttttccctactttacaaatcaaatgcattcatgctgagaagaatacattcccccttttgatgtcttagacttcccttgaaatagtctgtggggagttgaggcaagtagataaaagaagataaaatccctgaatttttcttttgatgatttcctcttattcatatttcctttgaattacaatctccttatttatctgtttcacttggataatggacattttaataaaaattgcctgtatttattttctttgatgtatttcataatgcctcaacttgcaggcccaaagtcatggacgagagtcttgttatatttttattaccctgagattcactaaatccacatggctatccacagtgatgatttcagctcccaatgcaagctcaatattgattttatctggattgtggactactgaatgcatcatcacctcatttaattgtacatgcttaccgcatcattttgcctagaaaattgaaatcggtggaaagaattacagctaggcaaatgcaaagttgtgtgtgtgtgtgtgtgtgtgtgtgtgtgtgtattgagggggaaggttgtctttccagcagttctgaataaggaattttaaaaactggtagctaattctgttttatacctgaaaataagaaaggtttcaatgtgttacttttttttttttttttttttgagacggagtctcggtctgtcgcccaggctggagtgcagtggtgcgatctcggctcactgcaagctccgcctcccgggttcacgccattctcctgcctcagcctccgcagcagctgggactacaggcgcccgccgccacgcctggctaatatttttttgtatttttagtagagacgaagtttcaccgtgttagccaggatggtctcgatctcctgaccttgtggtccgcccgcctcggcctcccaaaggtgctgggattacgggtgtaagccaccgcgcccggcctcaatgtgttactttaagtgcattctttttgggggaatggctggggtaagtatacattttcctgtatgagtgctactttgtaaatgctgcagctgttagcttaggctaagtttagctgcagtaataaatgactccacaaatgtagtgtcttataaccaaggtttacttcttactcaaatttcgtgatggggtctttatttatatacaaaactatgaatatcaaaagaggtaatactgagattttttttgataaaaccaaccagggagggatttttttttttttttgtaatctgacattatagtatgcaaccaaccaactaaccaacccaataataggaaatcaccatgcttagttggggcactgtggctcatgcctgtaatcccagaacttcgggaggctgagtcaggaggatcgcttgagcccaggagttcgagaccagcctgggcaacatggcaaaaccccatttcttcacaaagtacaaaaaattagccaaatatggtggtgcgtgcctgtagacccagctactcgggaggctgaggtgggaggattgcctgagctggggaggtcaaggcttcagtgagctgagattgcaccactgcactccgccctgggaaacagagtgagactctgtctcaaaaacaaaacaaaacaaaaaaagttaacctcattctttttttttgatatcacacaacttgcttgcttgatttccagctaaagcccaaaaggagagaattcacaaataaagccttccttttgctctagtgatccaagtaatgttcacaaatttctgctttgatttggtagcagagaccaacacatagagagaagctccacttggattcacatttacagttttatcagatgatgatggatgaattcatagctgtatagtcctacctaacaatgcagaatccagaagtctgtgggctaagttctctgttaacttatccacatcagagagcgttcattaggtgcatgtttgccagtggccttggcactttttctgcagagaaaagttactctttcagacacacacctctgaagccctccaacatgtgacagttgactgatcatgcatatgagtggataaagtcaatcatgcatgaataatttcaataagtcagggataagggccaattgttggaagatgagagatgttgaaattattggagttgtttgcttagatagattcaagtccaaggaagtgaaatcagctgtcaagccaaggcaggcattataaaataatagaaaaagaagaacaaaaaactgaggatagaattgattaaaagaaatttcgaaaagttccgttgaattcacttgcctttcacggaatgccaattttaaatctatggcacttagaaacataagaaaatttaaaaagacaaatagaaatcagaaaaacaactaacacatttgttagatcaaagaataattgtgaaataaataatagagcagcttttgcatatagaaagcactaaatgaaattgttaggtatcatccaacaatcccatatcatacatcaaaccattacatgctggtagaattacagaagtccacatggagtaaacacattgtttaaaaattaggcatactattggttgtttcagctttttctgtgactgtggcagatgcttgatatactcattaaggttttcctttgcaatgtgacagttcgggtttcaatgaactatatttcccattcttaatgtgggaaaaagacagatttcattttgcacactgaaactctttgggctttttttttttcctctgcagatttgccattaaattaggctcatattttcatcacgagctcttagtttctgttccccagtagaacttcaagacctagagatgtgccacccattaaaaactgaatgattcagcatttttcatttttagtggataaatatgctcttgtggataaatatgcttcagtggataaatatgctgcatttccttccttcttcttcctcctcctcctccttctcctcctccttctttatagagacagagtcttgctctgtcacccaggctggagtgtagtggtgtaatcatagctcactgcagcctcgacttccagggctgaagcgatcctcctgcctcagcctgccaggtagctggactacaagtgcatgccaccatgcctggctaatttttaagttttttttgaagagatggggtctcactatttttcccaggctggtctcaagctgctggcctcaagcaatcctcctgcctcagcctcccaaggtgctgggattataggcctgagcaactgcacttggccttgaactcacttcaaaaggaagacatttatatatttttttgttgtggtaaaatacatacaacataaaatttaccatcttaatcatttttaaatgtacagtttcatggtgtaaaatacatttataatgtggtgcaactaacaccagcaacaattttcatttggacttacatttatttacttattttaaattaattgattgttttttttagagacagtgtctctcattgttgcccaggcattccttgttttagcttctactcccatcttttttggttcactatttctaccctgactataacaacttaaccccaccatgaccttcaatattcattataccattttttactttatccccaccccctacatgcattttcccacctaaccagtgcacaatctagaagacagtctgttattataatctctcctttagaaagagcctggatacgcgagcccatctcttacttcattgaacttcgtcatggtaataaccgttctaacattctccttctctgttgcagacttcaactctcttgggatcttattgtgcaccccacatctgtttcttattctccagatctgtaccaggggctgccaaactgcagcccatggctcagtccacctttatttatataaattaattgttattggtacagagttgtaagttaccgactgtggttggcagctagcggtgctggaaaagaagaaacagccacttcgatgcattccctttaagtccatgacaacaaacctcaagtaggtatataatagtactttagaatcctactgcatttccccgggacattcagacagtcttctggagagaagtttcactttctttcttttcttttgaaatatcttttttgccctttattctcagttgattattgaacctggttttactgaagaatagaaacaataaaaagatttcatgtggtccttcagctgcatctcctcatgtatatatatcagattcatggatgcagccagtcctgctgacacctgtgcagtggtcctgtccaatgccaccacctctgttgtgcaaacctcccatactctcttgtgaaataaaaaatgtcattcttatattccccactcttttctacccctttctatctcttttgcagcctgcctgtgctactgttaatgagtacaaaaagcagttgttttaaatttatctttgacttttatttttttagagacaaggtcttgctctgccacccaggctggagtgcagtggtgtgatgatagctcactgcagcctcagactccaggctcaagtgatcctcccacctcgtctcttgaggtagatggtactacaggtgcacaccaccacacctggatgatttttaaatttttttagagatcaggtctcactctgttgcccaggctggtctcgaactcctgacctcaagcaatccttccacttcagcctcccaaagcactgggattacaagtgtgagccactgcacccaccaaactatagttagatagaaggaataagatctagtgtctggtagtatgtcgcaggctgaaagaatgagggtcatgatcaactcagtataccactggaggctatatgagtaaacagcaaactgttctcgtaaatgcagaatgttggcaaactgacaaactgtatctgccgcccagaaggaatgctgagggcagtcatgccccaagcgcagtgttgcttgtgattagatgcatctgaagcctgttaggaataatgtgaacctgtgatcaattaagcagctgaccagtcattacctcctcctccctgctctttctacccaataaatacgaagggctgtagaagttcagggctgctgcctttgctcactagaagcaaggagccctcctcttcttccccaaacctcttctttaaaacagtttcttttgtcttaagttttcatttctacattcgtccccttttgttcagtcttgtaatgatggtctcaagtagtaacagtagtaactgttgcagtgacggtctcaagtagtaactgtggcagtctgccacagtagtacaatcaggtgactataattaacaataatttattgttatttcaaaataactaaaagagtggaattgagatgtttctaacataaagaaatgataaaagctagaggtgatgggtactccaattattctaatctgatcatgacacattgtatgcttgtctcaaaatttcatatacactccataaatatgcacatctattgtgtatccataatagttaaagataagaaataaaactattattgttgttcttagtgcatagaatacttttctatcagagatagcgccaaaggctgttgctctctctgtttattttttagctcaactatgacccccctgagaaaggtgtcccttggtcaagccagaacactcctccagacccttatcctgctttagagttctttaaatccctcacctcccacctggcttattgtatattttcttgttcacgtgtttgcatagagcttccctgcaataaagtgaaaattacatcctcataattcagaatagtcctgactcactactcacgttcaatgactaaatgcatgggtagatggaaatgttacattttgtttgtttgtttgtttgctcatctttttccaggatgtattattttcctttcattgtcattccatcaattatcgatttatatttttggtatctgatatggtttgtacatttttggtatctgatatggtttggctttgtgttcccacccaaatctcacctggaattgtaatccccacatgttggaggaggggtctgctgggaggtgactggatcatggggggacttcccccttgctgttcttgtgataatgagtgagttcttacgagatctgatggtttaaaagtctgtggcactgccccattcaatctcttgctctctctctctgccatggtaaagacatgctggctttcccttcactttctgccatgattataagtttcctaagacctcacagccatgcttcctgtacaatctgtagaactgtgagccaattaaacctcttttcttcataaattacacagtctcaggtagttctttatggcagcgtgagaacagatgaatacagtatcctttaaatttccttgtagtttagtaaggctggaaagggtaaaggggtagaaggatgaagagaagttggttaataggcacaaaactacaggtagagagaagaaataagacccagtgcttgataaatcagcagagtggctctactaaacaacaatcgtcatgtatttcaaaacagctagtagagaataagtcgaatgttctcagcctaaagataaatgtttaaggtgatgggtgtcccagttacactgattttattattacgcattatttgagtgcatcaaaatatcacaggtactcccaaaatatatgcatatatatcaatttacaaataggtttgagaaaaagagtgcaggaaaatatgactcctttgcctcatgttagggttagcttctcaaagacattccaggcaggatgatgtgtgagaaaagtatttaatagtgtgaggcaggagggcatttatttaaacatgtgtgctctgagcttagcttgacctcacttcgaagcccagttttgccacttgagagattcatgtccttaggtcatgtttcaaactcccaaagattttactgtgaagtacctcatggggcacatgacagttaacaccttgtaagaatttgtaaagattaaataaaagtatgtctataaagccttcagcttggtgccaggaacacagtaaacacacagcaataaggggtgaacatatatatatatatatgtgtatatatgtatatttagccattatttttattattgtcattggcagacaaatgttgaaagatgaggttcttagtgcaagccctaaaatttcataacaattaaaatagaattgttcttctttgtcatctgtgttatctgcatcttaaatgacttggtcgagaaagtttttatgcttgcattttatttatttttaatctgaatgtgattcttcaacatggtgctggtggtgaatggtgatgacggtgcagtcccactgggaccgacttcatgggtgtgtgaccaccaagcgtcaagcattgtctcgcactcctgcagagacccgaccacatgtttggggagtatcacagtcaggtgcacacaccaagtgtcaggcatgaccctgggtgcctgtgcgggtgtgcacttacccacaaacacccccatgcccgagagagagcacagcaatagatagcaaataaaagctattctaacaggaatgaggtggtatctcattgtagttttcatttgcatttccctgatgattagttatgtggagcactgtcttagtccatttttgcattgctataaaggaatacctaaggctgggtagtttataaagaaaagaggtttatgtggctcaccatgcttcaggctgtagaagaagcgtggtgccagcattcacttctgtgagagcttcaaggagcttccatgcatggtggaagacgaaggggagctggtgtgtgcagagatcacatgacgagaggggaaggaaaagagagggaggagccaggctctttttaacaatcagctctcatgaagactaatagtaggaactcaccccctccaagggcattaacctatttatttatgagggtctgcctgcgtgacacagaagcatcccattgaaccccacctgcaacactgacatgcaatgaaaacatgagatttggaggggacagacatccaaattctagcaagcaccttttcatatacctgtttgccatttgtcttctttggaaaaatggccctttatctgtctgttaatctggtgatttttttttcttttgctattgagttgcatgagttctgatatggtttggatttgtgtccccatccaaatctcatgtcaaatcgtaatctccaatgttggaggaggggcctggtgggaggtgactggatcatggggtagatgttctccttgctattcttatgatagtgagtgagttctcatgagatctggttgtctgaaagtgtgtagcacctcccttttctctcttcctcctcgggccatgtaagatgtgcctgcatcgccttcaccttctgccatgattgaaagtttcctgaggtctccccagccatgattactgtacagcctgtggaaccatgagccaattaatctcttttctttataaattacccagtctcaggtatactagaatggacgaatatgagttccttttataatgtgtgtattaactccttaatcagatatatagattgcaaatatcttctcctttgctataatgctgcattttcactgtgttgatggcttctttggttgtgctgtacctttttactttgatgcaatcttatttgtattctttttgcttttgttgcccatccaaaaaattattgccaagagcaatgttatggaagtaaaagacaaaagatgacaagtgccagtgatgaggtggaggaagcggaatccttacacactgttggtgggaatgtaaattggcccagccattaggaaaaacagtatgaagtttcctcaaaaaattaagacagaactactataaaatccagcaacctcactactggggatatatctaaagaaaatgaaataaatatctcaaagaaacatctgcatctcccatgttcatggcagcattatttacaatagcctaggtgtagaaataacctaagtgttcatcagtgaacaaatggataaagaaaatgcagtgtatgtacaccgtgtcatactcttcagaatctacaaagaaggaaatttggttctttgcaacaacacacatgaaactggaggatgttacattaagtgaaataaaataggcacagaaagataaatactgcatgtccatttacatgtggaatctaaaaaagtttaaatcataaatgcatagagtatgattaccgggagctgaggggcaggtgaaataaggatattttggtcaaaggtaaaaacctgaagttatgggatgaacaaaatctgggaatcgaaagtacagcatggtagtgatgaatgtgttaagcaattagcttgtggtcatcatcacacaatgtatacaggtataaagtcatgctgttatacaccttgatacaacctttatgtactaaatagtttagaataacaaattttaaaaaggcaaataaaaacactatgagaggtggagagattgagatcacagaaaaaatatatcactttcttgcttttttttttttcacaaaaggcctacattttcttttgcactgagccccactaattatgtatctggcgctgaagaccccattaggcattcaagggatcccacactggacccccactccttcagtgacttagaaatggaatctgaaagttcaataaaacactagtggctgaaagtagcctctgtatgacggatccacttgggacattctccagctttagagaaaggtagataatgctcaggtttagggtataattggtcccatcaaccaggtagtgagcataacacctgataggtagtcttttagtcctcacctccctccctgctctagtagtccccagtgtctattgtttccatctttgtgtcgctgtgtactcgatgcttaggtcccactcacaagtgagaacgtgcagtatttggttttctgttcctgcattagttcacttaggataatgacctccagctgcatacatgttcctgcaaaggacatgatttcattctttttcatggctgcatagtatttcatgatgtatatgtaccatattttctttatgcaatgtatctttgtaacaaacctgtgtaccccgattctaaaataaaaattgaaaaagaaaaaagttaatactgcaaaaaaatggaaacacttatagtgtaatgttttgagagtaactttgaaaaatataagcattaacaaaaactggaaggaaaaactgaaagatgttacagttggttatttctcagtgataagaccatgggtaattgctattttcttcttctccaatgtgctgcactgtgtatattttactattttaatcagaaacacaatacaccttttttttttgacatggtctcactctgtcacttagactggagtgcagtggcacaaccatggttcactgcagcctcaaactcctgggctcaagtgatcctcctgtatcagtcccccatgcagctgggaccacaggtgcatgccaccatgcccagctaattgttttaatttttttgtagagatgggggctcactttgttacccaggctgatcttaaactcctgggctcaagtgatcctcccacctgagctcccaaagtgctaggattacaggtgtgagcccctgtgcctggccaacaataaacaatttttaaaactgctaaaaaaaaaaaaagtagaaaaactagaagatgactgatgtccttttgtgaaggcttctttaggacctgggtacagggttgcagaagatcattcaaacccttctgaagacgctttcgtagaggcattgcaaatttaaagacccaaagaaaggtcttgaatgcaagtccttttcaaggaagtctcaggaaggctttggtttctgcagtccctgctgtaaaacactggctttaacgagaatgctgtgacactttatgtggtctcacatgagtagcaaatgtttgcacttcccttaacacctgcctgttctctgacccagttggcatttggtaatgggagaatttttagttcctttaaaacaggagcctcgttgaatacagtgcctgagtgcagtgccagcaaaattcatagcaccaccgcattccatattctgtgagcggcagcctattaatggcagtattgagaataagaggcatgtaaatcagcctagaagtggatgatcttgagtttcaccgtgttttgcagagactcattgggacaatgtgccacagggaataatctgcactgattctgatactggggcataatgtgaatctattttcattccacagaggtatgccagcatcactctgatcaggaatcactttttggctacatatttacaatgttttagtacattgcattccccaagcagatgatacagtcttcaattcaaactttattgcatggacataatgtatcccttgaagcttatctggcatgtggcatttttaaaacgtaggtgcctaataaatattcattaaatgttgaatggacgttgaattgaaggtcttccttttgtgaagttacccaatgcatgtcacattacagatctgtatgtttcctaaaatcactgataacttttttcttttccattaaaagaaaatttagattcaagaggtacgtgtgcttgtttgttacacggtatattacatacgggtagggtttggattcctagtgtaccccaaaactcaaatagtgagctttgtaccagtttgataatttttcaaccctcacctccttcacatcctcccttcttttggaatccccggagtctagtgttcccagctttgtgtctgtgtgtacctatcgtttagctcccacttataagtgaaagcatgcagtgtttggttttctgtgtctgacttagttcacttaggataataacctccagctccagccatgttgctgcaaagaacatgatttgttcttttttatgtcagtatagtatcccccggaaaatcagtgatcattgatctgaactcagtatgtgtgcgtgtgtcagtgctactggcttttaatcaatgcaattgtactgattccctctttccatcaccagccatcttacatcattttcaatatttgcaacttcttcacaaatgcaaaaatatttatctttaggtctatccacatttcattttttattattatccatatttcattttttattatttttattttttgagatggagtctcgctctgtctcccagcttgggtgccatcttggctcactacaaacctccacctcctgggttcaagtgatttttctgcctc[213 bp omitted]aacttatcaatcattttgataaaaggattgatcaaagcctttgtgctcttattttctcaagttattgttgtgctgcattatattaagatgttttattattcaaataaaggtttgaacataatattacatgttgttccatcattttgggtgattttttgttgttgttgttgttgttttcctgaaaatgatcttttgcacttgtaacccttatgtgtacacagtatgttatttctcaattctcggatgagaagaacattaaaatagaatttattgacaaatgactttcaatttcccacttgtgagaataataggatcatgaacctttttgactggatatgaatatagattaaactgcggttacagttttaaccagtagatggaattatgaacaatttctagaagacttcaactatgcattcaattttagtaaatatggtaacccctctttccctctaaaatagctaataggggagctgttttgtaagaatgtttttgcctcgaggcttttattttcttatttctatgaaagaacagcatgcttacagatttacaaaatgtcttgtaacagacacttggactccaacatcatgtatgtggccagaacaggccattttcttcaagttcagcaaaaactttgatagagaatgtttatttgactttgggaaaaaaagaacatggagttagaagttgtggtgttgccagaaaaggggttttgatgtagatcccaggagagggttcttagatcttgtagaggaaggaatttaaggtgagtcacacagcacagtgaaagaagcaagtttatcagaaactattccattacagagtagggtgtcctcagatagcaagagaaggaacgtcccatctttgttttaggtttttcttagataggggtcttgtttatgtaaagactaagctaagctgtgcctacatgtgggtgggtggacagcatgacaaaatttattattttattgatttaaatacaactatccttggcttcgaggtcaacttgaaatcttgatttgaaagccagcaaaacatctggggtctgctcaatgtatgatgctttaacattttagtgtgtaagtacatcaaagcatgactataattattctgaaagcatatattttttatgggtatggggacatctagactttctgtttttgtagaagtgtgtccttgtagatatgtttaagctatttcctcaactataaacatcttatgaccatgtgactggcaacgagtgtgtcttgctagttttatgatgaagttgattttaaaatgatgtcaccctggctctcctaggcttcctgcttcccgagcaatgggatatggagaatggtcaacattttaattctgcctcttctgcttattagatgggtgggagccgatgggccctttaatggctctaagtattaaatatgttacaaggggtatctcgggggtcccagagaccacccccaggtttggtgattttctagaaggactcactgaactcagcatgtagttgtcctcgcagacatgatttatcacagccaaaagacccaaaacaaaatcaacaaagagaagtggtgtatgggtaaaagtctgaaggccactgggcacaaatttccaagagtcctctccctgtggaatgaaacagggcgtgcttaatccatccagtgatggcaacaaggcccgtgaaatgctggccactggggaagctctcctgagcctggaaacctggggtttgtattcagtctgtttgtgtagacaccctctgcttaggacattccaaaattccagactccaggaagaaaagcaggtgtgcagcataagtgatactgtttatataaacagtttagacagaatgagccattttctccattttgagaatagtgggaacccttctgaaatctaagttcccatatgccagtggatagaaattgaatggtgtccccttggtccaaattcatatgttgaaatgccgatatgcgctgtgactgtatttggaaatgaggcctttatggaattaattaaggaggttaagtgacgccatagggtaggatcctgatccaatagataagactggtgttcttataagaacagacctgacagctctctctctctctctctgtgtcaaatgagggcacagagagaagggagccctattctgcaagccgggaggagagagtcaccaggaaccaaatagacccagcaccttaatctcagactttccagcccccagaactgtgaaaaaataaatgtctgttatttaagccaagcaacctatggattttgttatggaagccaagctgactaagacaccagccagtggccaatcatgcaagctggccttgctataaagaaaaccttctgcagcctgctaggttaattcttctttgcacacaagaataatcatatcaagtttccatggctgtaaaggttggaggagatgatgcatttctggggtatgttaaccaaaattactgactgaggcaagagtctcactcattagaggtttatgaagccagagcttgagggtccacccaggaaaaacaccagtgatagagggtctgtggtctatgagcccaaagtatctgagacaggtctcaattgatttagaaagcttattttgccatggttatggacacgcctgcaacacagcctcaggaggtcctgacgacatgtgcccaaggtggccgggacacagtttgcttttatacattttagggagacatgagacatcaatgaatatgtgtaagatgtacattagttaagtccagaaaggtgggacaactttcaacagggcttccaggtcataggtagataagagacaaaaaaatgttgtattctttagagtccttgatcagcctttcactgaatacataatttattctggctcattgaatctacatttttacttaagcagtagggcagaggaagcaatcagatatgcatttttctcaagggagcctcagagggatgacaaaggttttaaaaaagctccatacctccctcacaattgaggcctcacaattgagggaggtatgtagcttattaaaatctttgtagctattctatacaggaataaaatgggaggcaggtttgctgcctgacatagttcccagcttgacttttccattggcttagtgatttgagggtctcaagatttattttactttcacagatcagtgttttccaaagagcttttcaggatggttcgcatttatacattttcttaaagggggacaagaggaatgggtagaagaatgattgatttcatgttgtctttgttctgttcctgggaaaataaccgttatcagtgagaaatctaacagactttagttttttagaagctagacttagattgcagacctaaagttacaattgccatgtccttgtttatgggaggataggcatcaaatccaacaaaacatctggggtctggctactgtataatgttttaacaaaagattgtgaagtatctgttattttatttggaaaaaagatattggcgttgcctgactgaggcttcactttactttcgccataacaagtttgggggtcctgagatgtttttattttcctttatagatataatggtttgttcaaatgtagggtgagtacgtacgcttgcgaacaaatcagatgcactcaattaaacagcatggccacaaaggcttgctggcttacctgatgatattgtcagcaccatgaggtcttctatgacttggtaagggtcttgggccagctgaagggggacatccctgattatggacccgcaagtggccttttcagtgggagctctgagccccaggctggttggagcagcttacacaccagtaaggaaagagatacagaggtatcattagggagtggactgacagtggcaggacccctgaccagggttttaaatttccttttacctacgtagcagcagtgatgaactgaggacaatggctaggatccacacctcccagggacagctgtcttgttcaccttctcttaacctgtgttggtctcaggtcctcagaccaactccatggttttaaacattaaggatgcagcaagcaccactcataggattctgagttaaaatcagagttgggatgacttgtatgaaatagctacctcttgccccaacacaaagtagaatttctggtaaaacatccgtggaacagactggagagagttttcgacgcgctgtctcaaattcaaaacctgggccttgggtttcagtttctgaaattctaaaagctcctctggaacttgacccaggagaatctgatcaaccgtaattccagaggtgtggggataatagtgatcagagggcgtccgatggcatactgccatcagacaaatgccattttatttttcctggactttttctagtgggtagcatgactctgcaaatttcaaaagggagtaaaatctaatactgagtttccattttccatggggactgaaattctgaaccaggtcataaaaccccactttcagtaaactctatactctcattctcattagtcttccaagaatattaaaagagatttcaattcaaattctgcaaatagtgagaccgaacatattgtatgtattacatacttctgactattaatacatccaggggagcttcaatttacatttaaaaaagctgaaaattcaaaaaaagtaataggctggctatctacatagccaaataaaaagaaagctgtatgaattgtctatttaattccagtaaaaggatttttgtttctctcccatattttcttcataaagctgaattttttttctgattttgttgcagtttcttgcttatttaacttgagttttttaccttccccaaatactaaggttttggagcctctggtgtttaatttcttactactaatcttatcaatattgaattggattttgtgttcttattgggtttggaagatgtagttccttcagttcaaatatatacacacacacacacacacacgcacatatatgtgttcaaaaaacggagccttgggttttatatatttacatataaaatatataaatgtttttataaacatattatacccacacatatatacacatacatgtatacatacacatatagatgtgtagatatacatgaaatatataatatacatataatatataatatataaattataatgaattagttaatattattatgtataatataaaattatatatatattatgggataaaatgcctgacactgtagcctctaaaagcccatttaaatttaaaaaaccatttgaataaacagaaagctagaaaaacaaagtggctattataaactcatttaaatgtgcagtttaacaatgaatgaaaatatcttgtctcattacagtattttgttaaaattggagggaaactagcatgggataccaaatcacagtaatctcagaaataaaattataagattaattatttgaataacaaaacttattttccataaacattgtgttgattttgaaatatagaatattattaaacaaaaaaattgaagtttttattttactggcaaatcaggttaattgcctcaaattactttggaagcctcaatgttctttgctattactggtgaaatatataggtaatgtgatttctaatcccaataaagtcatgataggatgaatagaataaaagagaatgtttctaatagtatgacaagccagtatgtagtgttcttcttagataattttccagtagcatcacacaacctgaaactgagccaattgtcccatagactgttctttttgataaacatagaaattgatcctactggttttagctcttgaaacttatataagttttatctgagttccttcccaggaaaggacctttagacctctcaaaaagcatcaaagaactgaaactcaccagatcactgcatgctgacagtgacatggcagagccctcattcaccatgattgcttccttgcccttccctagtttctgttttcctgcacacggttacatttcttcccagctgtgtaaccccctagttttagtcagtcagggaggtggatttgagactgagcccgcatctcctcagctgcagcacccaattaaagccttcgtccctggcaatactccttgtggctttctgtgtggcaagcagcaggacctagaccaaacccctggtgtttccgtaacaaatctagctgttggcattaagtaggatccaggcaggacagcattcatagcccagtgctggcttgtaacacgcttttcctcatttaattttcacaatgcatattttcttgctgcagaaagaggaagaggttttgtttctctaggattctgtatttgtgtcttaactcactttctttgactgtgtagtttttggcagcatgggaatggagcagttatgatcacaccctcatcaccactgacaaaaaatggcaataaatatgaaaataattctattcaattgccctttcacaatacatgctattttcctaaagacagagttctgttctcagaggtctgaggtcttttctcagaaacctaggctgaaacttttggggaattaaaaaaaaaaaaagagaaatggaaatatttttcgaaagaacttcgcttctggatcccctaatgtcttcagatgagcaaagccatctttttctccttttcttttgaaaacaagctgtgattctcttactagtctaatgctgactggtgtagtttttagtagctcttcacgtttgtgtagttgtgagatagttctgttggtcatggaagactccttcccaggaagtcacaccatgctcctgtgtaggacacagtgtttcaccctttataagcagaacagctccaactgatgctaccttgtagcaacctatatctgtaatgaagaaatctgggtccaggaaaggaaaggaatggaatttgctcaagagaaactgtctccaaagaattagtttctaactttctggacatgtatgtttttctaaatgtacaattggtgtctcacgttcagccagttccaattgcctaaatgtcacatataggctggaaaaaatatgcatgtatctgagcaaggcttttttgcaagacttgctagagaattggaaggatgaaaaagtaaatctgagtgcagttgtcagcattaaagacactttggcttcaggcaatgccagagaattgagcaggaaagacttggcctgagacttaccatcttatattgaatgtgcgtctggttattaatatgatgcctcagttctcccagtgactccaggacctagggccaaatttcaaagtcagatggatattttatcagtgacaacttgcacagatatagcgggaaataaccgagaaaggctaatttctagaattttataggtgagaaaaggcataaaacattactttatctataggctgaagctctgaacaaaaagaaaatttctggacagcaaaagtttggcaaattgtactctatttactggaatttagacacttagatatcaaaagtattacccccttccacttttttttggaggggggcaagctggctattgcccaaaataagagagcatgatttagtgtattacagttgcctaggctcttctgaatgtggaaactggatttgaaatttttaatgtgttaaaatgctctttgaaactctctccaaaaagtattttctacatcagaaaagtaagctgcacttggaaaaaaaagaaaattagttataggctatattatttggtgtatggtaaaagctacaaagtcattatataggcactgtaagtttctctgggttagaacggctacttctactcacagaattaaaagaagaaggagaaagaggaagaggagaagcaggaggaagaggatggggaagaggaggaggaagaggaaaagaagaagaagaggaggaggaggaaagaacatagcacaagaatatttcacatggaaagaaaaatataagaaaactgaaccttggggaaattagaaatttatattgaaaattatttctctttaaatggtcttaatggaaataaaatgaaacttctctttttaggaaaatggcatttattattaatgggcagtttcatagagttctttttatatttatttccctttttaaattatactttaagttctgggatacatgtgcagaacgtgcaagtttgttacataggtatacacgtgccatggtggtttgctgcacccatcaacccgtcatctacgttaggtatttctcctaatgctatcctgccctttgccctccaccccctgacaggccccggtgtgtgctgttcccctctctgtgtccatgtgttctcattgttcaactcccacttatgagtgagaacatgcagtgtttggttttctgttcctgtgttactttgctgagaatgatgatttccagcttcatccatgtccctgaaaagaacatgaactcattctttttttatggctgcatagtattccatggtgtctatgtgccacattttctttatccagtctgtcattaatgggcatttgggttagttcctagtctttgctattgtaaatgtgctgcataaacatatgtgtgcgtgtgtctttgtagtagaatgatttataatcctttgggtatatacccagtaatgggattactgggtcaaatggtatttctagttctagatccttgaggaatcaccacactgtcttccacaatggttgaactaatttacactcccacagtgtaaaagcttcttatttctccacatcctctccagcatctgttgattcctgactttttaatgatcgccattctaactgacatgagatgatatctcattgtggttttgatttgcatttctctaatgaccagtgatgatgagctttttttcatatgtttgttggccacataaatgtcttcttttgagaaatgtctgttcatgtccttcgcccactttttcatggagttgtttttttcttgtaaatttgtttaagttacttatagattctggatattagccctttgtcagatggatagattgcaaaaattttctcccattctgtaggttgtcggttcactctgatgatagtttcttttgctgtgcagaaactctttagtctaatagatcctgtttgtcaattttgacttatgttgcaattgcttttggtgttttagtcatgaagtctttgcccatgcctatgtcctgattggtcttgcctaggtttttctagggttcttatagttttaggtcttacagttaagtccttaatccatcttgagttaatttttgaataaggtgtaaggaaggggtccagtttcagttttctgcctatggctagccagttttcccaacctcatttattaaaaagggaatcctttccccattgcttgtttttgtcaggtttgtcaaagatcggattattgtagatgtgtggtgttatttctgaggactctgttctgttccattggtctatatatctgttttggtaccagtaccatgctgttttggttactgtagccttgtagtatagtttgaagtcaggtaacgtgatacctccagctttgttctttttgcttaggattgtcttggctatatgggctcttttttggttccatatgaaatttaaagtagtgttttctagttctgtgaagaaagtcaatggtagcttgatgggaatagcagtgaatctataaattactttgggcagtatgactattttcgcgacattgcttcttcctgtccatgagcatgaaatatttttccatttgtttgtgtcctctcttatttccttgagcagtggtttgtagttttccttggagaggtccttcacatctctagtaagtatttcccttttttataatactgaattaccaaaatgtctattgctcattttaagagcagtagtttgttttaagatatgggataaatattctttggagataaacctgtatatttctgcaaatatttcttcctgaaatgtagactaagatatcacaaagcacagattttaaagcacactttggctttgatgcttacagaatcctacatttttgaagcccaaaatattccgataaatcaaggcattcacacaatgcaatcattctctctgtggcgttcccaataaatgaaatgtactgaaacttttaaatgaggtggatgctcacaaaacagttgctagggttttgttgtaactgttgatctggataaaattttaaactgacagtaagagtggcaagaacagtatggggaaacgctacatgcttttctgcagatttgtccatgtctatattttgtctgggttgttttataattcattctctctctgcaccccacacacacacacacacacacacacacacacacacacacacacgcaatttcttcacaaccatctgagaataagtcagataattgtacccttctactcctaaatatttcagatttctttaaaaaaaataagaacgttcttttaaaaaaccaaatacttgaaatcagaatatttcacacttgtacaatgttaaaaaaagatgtatgcttgtagtaagacatgaataaaccacagaacttcagtgtttcagatgaaatctactgaccacaaatgtttctaaaattcaaccctaagcctggatgctctcagctagatgttctgggcttggaagtctcttcatgatgacactgaagaatgcaccagggtcttggtgcatctctgttcccctgatccactcctaggaatagcaatatacgtgttccctgacctcagttcaggctaaagatgatgtcttaatcattctttagccctgttcagcctgaattccagcccctgaaagggaatctctgtggctaagtcaaagaatgacctaaaggtggccaagtcaaaggaccatggttctccatcctcatcttgcttggccccaatgtagcctttgaccttgtaatccacttcacttttttttttttttgaggtggagtctcaatctgttgcccaggctggagtgcagtggcaggatctcagctcactgcaatctctgcctcccaggttcaagcaattctcctgcctcagcctgttgagtatctgggaccacaggtatgtgccaccaagtctggctaatttttgtatttttagtagagacagggtttcaccatgttggtcaggctggtctcgaactcctgaactcaaatgatccacccacctcggcctcccgaagtgttgggattacaggcgtgagccaccgtgcctggaccacttcaccttcttgaggcatcttcgttcctcagtttccctgatctaatgggtatccccaacaatagttccagggagacaatggaaacgattctaccatgagtctgggtgaaaatctttctcatgacaggaaaacaaaattgtcagctagtgctccacaaaatattgagttacaaataatcttagattagttggtggctccatccttgtcacttacctctcatttataagtgagaacatataatatttggttttccattttggagttacctcccttagaataatggcctctggctccatccaaattgctcaatcaaaattacatgatttcattcttttttatgggtgcttagtattccatggtgtatgtataccacattttctttatccacttgttggtcaatgggcacttaggttggttccatatctttgaaattgtaaatgtgttgctataaacatgcatgtgcgtgttgacagacacattttatttatctcattttattttttatagatgatcctgtcttcatttttccctgcagttttacagaataatcctggaacaattatccacccaaaaatctttctgattttccttgggatacttaccttaacaagagggttcattcacttagcgcaggtcagcaaatgccatgttagctgcttttagtaatttaaggggatgtcatatctccctcatcttagggttcaacaaatgttgaataaataaggtatccctttgaatattgcttctctcatgggttaccttaaatgctattgaactctgaatctagatttaaatgccatgatggaatcacataggatatttttaattttcttccttgtttaatggatcgttacagaaagcagtattttataattaatgtaaaacttttatgtttttatcattagtaggctattattttaggttctgggttaattccatagaattggggaaggcttaattggtgatcagaggtatgtaagtatattgagacatgatttatcatagaagaaatggaagagaataataagataatgaggcagacactgttgtaattataaggaatttttttatgtaagcagggagaactttaattatagatcattagtagcatgaaaaatataactctttaggttttccaagactctaatttcataataaacaggcttagttaatttcccatgggaatgttttcagtggagtgacaaagcgtgcacaaaacagatgatttgaaatttgtgtttaaaaacaagggagttggtcaccttaaaaattatttttcatacctaattgccattcaatttgatttctaaattatgtgttgagtttcactatagcctcagtactctttgatgtcttatggagtgaacaataagattctgatctgccattaaaaggagtaaaatatgagcagaagcattacttaaataactgagcaacacaatgtatgtttatgtgataattgaatgctgcaaatatatgtatttgcatgaggaagagatgatctggcctaatgttttcagcaaaggcctgagaataacacaagaaaatatgtctgagcaccaagttgagttaaaaagtgaatacagtgcaggaaacacagtggaaaataaagcctgaaggtgtccatggttagcttctagtgaaggtttatgccagggtgaccctgggcacatgaagaaggattttaggagaagttctatgatggtcatggcttcaatttaggaaggctgtcattgtaagctttgtgagtatgagatggacataatttatattagtaaggctatatacatgggtggaagaaagagagagtggaaagagaaagagagggagaaagaaagagggaagataggagggtgggaggaagaaagagggaggaagataggagagggagagagagcagagaggagaacaggggcagggggagagggagtgacagagggaagaaggtaacgagaatgagagagaggaaagaaagaaaaaaaaagagaaagaagaatgaagggagggtgggaggaagagagggagggaggaacaaagggatagagggagagagagagaaatatgtccacttgagaaagtaaaggtagagaatggtgttgctgagttattaaacatcttaaggatcaaagtaatgcaaaggtagaaaaacagcagcaatactgccatttctaaggcagggattgctgagtacccagacaatagaacagcagcaagaggatgcccccaaaatattatagctttagaatcataggttcatgggatgttagacccaatgttagcacttctcaatttaagaacagataaaacaaagagacaaaatcaatggcaaagaaaaattagcatttacaggaaatgattttattaagtgatggttggttgggattctgttgagggcttcaaactttgccagagctgactgctaaggcatggacacatctcctagttacatgagccttggtagatctatttaatgctgtagaaattctcagctatgatgacagtgatgaggatgatgatggaattaaactgaagaaatcaaacctcaaccgtgagtgtggtttccaaaacaatgagtcaatatttatggattggcatcaagaagtttttttttccccaagttcttcaggtaattaatccaccttgctaggatgacatggctccctgttttcttaaaagttgtgctggtaagcataaaattaatgtaaaggaggaaaatatatttattacttttatttgcagttgcaccaatacctttgactcctaaggccaatgaattacttctatttttttttttttacaagttgaaggagtcagattgttaaatatgggggcatgaatgagcagttcttgcatactttctgggttaataagaagttgtgggcttctattattaggtttacaagccaatgttttggttaaattatatctacattatatgaaccccaaaataattttggggtttagtgacaggaagaggaggggtcacttaccccttatccatctatccatatatagatgatagataatatatagatatataaattatagatagatgatagattgatacatagtagattgatgatactaaagatagatagattacttagggtgccacagatttgtgactgttgattcattcatacttgactgttcagtcattttccatatcctcatcacgatacttattcttgtttttgttgcaacccataattatgggagaggcctcccaaaccatctgggctgcagcacgcatatgtgtgctatattcaatgagatttctctcctgttcagaaaagcctgggagaaagcacatgagtgggaatggcataatgagggataaaacctgaagcccacttgaatttattgaaacaaattttttcacagaatttgacatttcctgattagtaacaagctatttccagccaacctcagaagtggtcatatcacttctctgcatcttgacattcatttataatcagccaagtgatgatgtctgtgacttggtggaactcatgatgagagaatcattccccttctctgtactcccctcaaaactccttgatttactgactcattgaatccttgcattatctactgttaaaataccacttacacatatgagtaaaaaaggaaaagtctacacaaagtaaagatagtattaggaatgttgcattagacagagtttttcagagaaacagaaccaataggagatggatagttagatagatagatagatagatagataaatagataggtgatagacaaatagatagatgatgaataaattcaatagatgaatggatataatatataataaatagataaataatattctttgaaaaccatactcatggctgaggtttaatttcttcactccaattccatcatcgtcctcatcactgtcatcataactgacaatatctatagcattaagtagatatatcaaggctcatgtaactaggagatgtgtccatgcctaggagataatagatgatagatagatagatgatagatgttaaatagataaaaaatgggttgttggctggatagatatggttgttggctggatggatatggataaaaaatggttgttgtctggatagatagatagataatagacaatagataataaatggatgcataatagatagatgatagatacatagataacggttagataatcgataatagatagattgatagatgacacacgggtgatagatattagatgatagacagggtgagaggatgatagatggatagatatcttctttatacatcaaggaatatctctatctctgttatatccatctatgtctctatcatctgtctgtctatctatctatctatctatctatctatctatctatctatcatctatcttgttttctatctatttcttaaccatgtgtctgtctatctatctgtcgagggatattatgaggaatgagctcaagagattatgaaggctgagtagtcccatgatgtttgtctggaagctgaagacccagagataagatgaactgtcccagctccaacagtgagaccagaaaaaatgggggcaagtttctctttcttctctacctttttgttctattcaggcactcggtggatttaataatgcctgctcactttggggaggacagtcagctttgctgagctcacaaattcagatgcgtatcacatctggaaacactctcacagacacacccagaaataatgtttcatatcgacaccacctagtccagtcaagtaaacagataaaattcaccaaaaccaatgtgaagatgtatatacatacacatgtagacagtataaatatgtaaagacaatatattgctttgcaaagaaattctgccttgttcctcagaacattcctataatgaacataggagagttggtttcattgcatagatgggtaagctgaaacaagagtttcatacctaaagtcaatgagtaagtagacttctaattcgacatttgttgttgattaatttatctttccagaaatttggtgtttgttttaaatgatgatgcatctgtgttgatgaatgttcagacttctacagttgcacatctgaacaagtgtggtatatacgagcatctatcactgagttaagtgtataatcaatcactgccaatgaccattgcttatatggcaattctagttataaagattctgtgaaggcaatgtggaaacagaaaaaaactaaacctggagctagaaagagccattgtcattggttggcccaagcctcctattttatagaggaaaatgaggcttggatagatgaatggatagaatatataatagatggatagataatatggccatgtggccatggtgaaaccaagctcacgctcacaggggaggttaaggggagagaaagttctagtaatttggctttgatttttttgtttgtttgtttttctttttctttttcttttttttttttttggacaccgggtctcgctttatcacccaggctggaatgcagtggtatgatcatagctcactgcagcctctatctcctaggctcaagcaatcctcccacctcagccttccaggtagctgggaccacaggcatgcgtgaccatgcctggctaatttttttgtagagatggtatctcactgtgttatccaggctggcctcaaactcctggactcaagtgattctcccacctcagccttccaagttgttgggattacaggcatgtgccactatgcccaggtggccttgatcttggtccatgtagttggctgaacgatggctccccagaatatatccacatcttggaacttgggaacagggccttatatttggaaaaagggtctttgcagatataattaagataaggatctcaagatgagatcatcctggaggaggaagggccctaaatgcaatgacaggtatccttctaagagacagaaaaggagacacagacacagaggagaaggccacgtggagacagacagagactgaaatgatgcctccacaagcccagggatgcctggagccaccaggagctgggagaggcaggaaggattcctccctagagcctccagagagaactggatacaatcgtaagagattgaatggtgacctccaaaagatgggttcacatctaaaccgcagaatctgtgcatgggaccttatttggaaatagagtctttgcagatataattagttaaggctctcgagatgagattatcttggaggaaggaaggccctaaatgcaagaagtatccttctcaaagacagaagaggatatgcagacacagaggagaaggccaggtggagacagagacagagactggagtgttacagctacaagcccagggatgcctggaaccaccaggagctgggagaggcaggaaggatcctcccctagagccacaagaaggaagtggacacaactttaatggattgaactgtggctcccaaaggaactgtggatgtcctcatccccagaaccagtgaatgggatcttatttgaaaacaacatgtttgcagatgtagctaagggaaggatcttgagatgagatcatcctgaattattcatgtaggtcataaatccagtgaaaattattcttataagagacagaagaggagacacagacgcagaggagaaggccatctccatggagatggaggcagacactggagtgatgcagccacaagcccagggattcctggagccatcaggagctgggagaggcaagaaaggtcctcccctggaacccctggagggagtgtggccctgccgacatcttcatttcagacttctggacgccagaattgggagaaaatccatctcttttgttataagccccctactttttttcagcaaacccaggaaaccaatacaggctatgttaggttcttttattttacgtggttcccagagtgatatacaatgcgtctgcccaggtgactttctcccaccatgtgccaggcacttgtgacacctgtgatgatgtccctgagtaacagagtcttgaggaaggactgtgccccaaagctgtgcctaactgtaatctgtgatttctcaactgtgccctttgcagattggttgtgtgctcttgggttcagaccatggaacttcctgcagaagaaagacatttatttaaacaagtaaattcaggtcgatgtttctacattttcagccataagtttggcagtttggaatcatcaatgtgatgttgtgttttcttaaaatgataacggaaatgctccaagcacttagcttttgagatatgataatgtgctttcctgacttttccagtagcctgttgcattgtggctgggacctttcatttattgcaaacctgagattaagacattaaaaaaaaaaacttcttggaggtaggatattacagggaatctgctgtttgctgcaaactgcctctttgaaatatgttagtgcaatcaaaatatagctgtttgaaaaggtcagtaagtcaccatttttcataggatatagaagacgtcaaaattgtgaatttttttcttttattatggaggtgtctaaaccatgacaaagttggataaattaattgcaccttttaaaacgatggtttaaaaatgctaactttaaaatatagaggttcaagtcttaacatctctactagtttggattagttaaaaaacaaaggtatcaaagatacttataggtatctcatcaataaatttctaatgtcagtgtttttgagacttaagtaatatacagactccttttctcagtggataattttggggcaactctagcaatagatattaaataagtacaaaagataaaacaggaaaataagtttaggaatgttcgatatggggacaaaaaccacaaaatgcatgccataaaatgccacacatttgataatctggtccatactccaagatatgagcttttataagacacccaacaaaggaaataagaggctataaatatgcagtacttgttcatggcctcccttgaccctgaggtatttgagggacactcctccttggatgtcatacatctaaacctgactctaaggatagctaagcatcatatagattaagagaaaggtgtaaaagggatatgggatagatatttattgggcttccataatgtgtcaagcatgttgcacatattaagaccttttctcatccatatgttatggcataaaactattcttctgatcttacagaacaagtcttagaggctagaccgctggttcacaggtttacttatcaaagtttaacagataatgtcgttttcattaaaaataatttaaattggtgctcgaatcaccatttctctaactcctgaccaaaacagattgttagtctcttttcatttgtttttgtcagataggacaaaacaacaagtcattgctttgatataatttcctttcactattaaaaatggttgcatattaccatggaatactacacagccataaaaaagaaagagatcatgtcatttgcatcaacatggatgcagctggaggtcattatcctaagtgaattagtgcaggaacagaaaaccaaacactgcacattctcatttataagtgggagctaatcattgagtacacatggaaacaaagatgagaatattagacaccggggactgcaagaaatgggacagagggagaagggtgagggctgaaaaaccacctattgggtactatgctcactaccttggtaacgggattaattgtactccaaacattagtgtcatgcaatatactcatgtgacaaacctgcacatgtaccctccctgaatctaaaataaaagttgaaattataaaaagaagctgtatatttcttagaaacctatttattagccatttctttgcttattgcttttatctttgtgcctctgacaaactgactccaatctgccttgtcccatgcttctgaaaggttttcatctcagtgtgtttgtcattctgcactgccacaagttcccagaagagcctcctcagagtgtgtgggacagtgttaaacatgacggttagagttcactcttgtccactgacagacacctgcctacttttgcagaatgacagtcaggttttggacatgcctggactcaatcacatggccttgaggatgcagaactctttcaagctgatctaattccacttagaggataaatacttgaagatagacctgctgatggctttctaaaaagagattctgacctctaactattaggttggtgcaaaagtaatagcggcttttgccattacttttgcaccaacctaatagacaattgtgtatgctttcttcttcatttcctttgaacatcttaggagcctgccatgctatttctgcaacttgattaaaacttgatgaagacaggtgttatcttttcagtcagaagaaagctcccctccttagtgcctagaacggcaggcgatttttctttctttcccgtttgaagctgtgtgtcaggtggctgaaatgtgaccaggtttactacccagtgggaatgggaggcctgtttttggagcggagaaaaacatctttctactggcttaattattttcattttacaaaaggttttttgagtctggtttcaaaagaatggagattagtgtgttgcctttcatcttacaatccctcaggatttgaaatgaactccacttttacatttacttaattttttctgtcagccttgactggcatcagatgccctaaactattatttatgaggaggcatttgacgttctggttcattcatccgtaatttctgtcctactttacaatggaaaaattatctcctgtgttccagctgcctgagatctcccaaatctaagcatagacgcagaaacaacattcaagagggcatggccataaacctttcctacccttgttaatggtacagcaagtcctaataccatttccatctaacagatgtgaaaaccaagtcatgacgtgatttaaaatgttttcgaaactaatgcaggatcagaaaaccaaataccgcattgttctcacttatctgtgggagctagaaattgagtacacgtggacacaaagaagggaacaatagacacaggggactacttgagggtggagggtgggaggagggggagaataaaaaaactgcctattgggtactacgcttactacctgggtgataaaataatttgtacaccaaaccctcatgacatgcaaattacctatataacaaacgtgcacatgtaccccctgaacctataataaaagtttaaaaaccaaaaactttctcaagtttgtacacttgggatgtatagaacacgtcactatatacatagacagtgaaaaattactggaagtatataacagactaaagtattagcagaagttatctttggatagtctttctcctcccttccttcctccctccctccctccctcccccctctctctttctctcttctttctttctttctttctttctttctttctttctttctttctttctttctttctttcttttctttctttctttctttctttctttctttcttctttctttctctctctctttctttctttcttctttttctttctttctttttctttctttctttctttttctttttctttctttctttcttcttctttctttctcttttgattatttccttccttccttccttccttctataattatttttaattttctcaacctgctttaaggcatttattaaaaacccaaagctgacatcatagttgatgttgagacgaaatgctttctgcctcagattagacacaacatcattgcagaggatgtgattccgagtgtcagagggcatagcctatgttacgtggctgtctggttgcagtttggttcatttaggaaaccttatataaatgaaagaaaagcatttccagaagtgatatggctatgctctgtgtctccacccaaatctcatcctgaattgtaatccccataatctccatgtgtcaagggtgggacctggcaggaggtaatttaatcatgggagtggttttccccatgctgttctcatgatagtgagggggttctcatacggtctgatggttttataagtgtttgacagttcctcctatgcatgcattctctatctcatctgctgccatgtaagacatgcctgttcatcttctgcaatgattgcaagcttcctgaggccttcccagctatgcagaactgtgaaccaattaaacctctttcctttataaattacccagtctcaggtattttttcatagcagtgtgaaaacagactgatacaagaagcctcttttaaaattatctatcagctagcatacaacttattaataaaaataggctacatgatgaaatattatgcagccataaaaaagaacaagatttttttttttttttttttttttttttttttttgcagaaacatggatggagatggaggccataatccttagcaaactaatacaggaacagaaaaccaaatacctcatgttctcacttataagtgggagctaagtgatgagaactcatgaacaaaaagaagggaacaacagacagtggtatctacttgaaggtggagggtgggaggatggagaggaccagaaaagataactattgggtatacctgggtgatgtgataataatctgtacattaaacccccatgacatgagttcagttatgtaacaaaccttcacatgtactcctgaacctaaaataaaagtttgaaaaggtaaaaaacaatctgatgtttatcaggcagaaaataggcttatcatagtaactttaaaccagtagagaataagatgattttgaaggaagaaaatgcttcctggatactttttcttttggtttttctcttccagctatgttgaagtcaaattcatttgcaataagattcacccattttaagtgtgttgtgcagtgattttggcaattgcctgtaatcatttcaagaccaccacagttaagatgttaagcggtctttattccctaaagtatttgtgtactcaaatcctctttgcagccaatctccatccccaatcgccagtcccaggaaactacatctgtgatttcttttttccttttttttaatcagaactacatcccttgctctggtaataccttcaatgtgagtgtgctggtgctatccatctggcaacagggtgaactcagagttggatctcatgttttcactttggtgtgaagaatattgaccctcagccgggcgcggtggctcatacatgtaatcccagcactctgggaggctgagg[131 bp omitted]aggagactgaggcacgagaatagcttgaacctgggaggcggaggttgcagtgagccaacgtcgagccactgcactccagcctgggcaacacagtgagactctgtctcaaaaacaaaacaaaaaacaaacaaaaaaagaatattgactttcatcatttcttacctctgtgatttttgcctgtttgatttcttcattaccagaattttatataaatggaatttagatagtatacattttttagtgttttatttctctcactaagcttagtgcatttgcagtttatatttttgtgtgcatttatgtttttgtttcttttttattgctgagtggtttattattgtatggagatgacatggttttcttatccactcaccagttgatggaagtttggcttgtttccagtttttggcaattgtggttaatgctggtatccatatttgtgtacatgtttttgtgggagtgcagattttcattttgctttggtaaccctgtaggagtgggattgttaggttgtatggcaaatatatatttcactttataagaaactgacaaactgtcttcccaagtggttacaccgttttgcagtgcaggagcattgcagctgttctacgtgactgcaaacactttttaatgaggaaggaagagctctacagggccagaatacaggctgcatgctttgataaaagtgacaaccatgttaaaaaagaatcataagactatgtgacaggaactgcagcagcacataggaaggagaagccttgacaatggggctaaatgtggttgcagcagaagtaatgttttaactgattcttgaactctctctgagtcaattgtctagaaagagagaataataaaggcaaaagggtaaaggcatctgtattccctccctagggttgctgtaataagttatcacaaactgatcacaagagagacaggaaaaggttttaggggaagcccaaagccttgccttccctagagaagtgaaaacaacacaaatcaagatgcaaatagctatgtttttcactctgtcgtcagcaaaggagggtggcatccccctgttcaatgtgatttttttttttttatttccttaagcttagctcacaatgcactaccctgcctggtgtcatgtggaatggtagttcctagaccacatttgttatatgaagaaacttcagacagagataaacttcagtagagactcaaggaatgttggatgtgaaatcttctatgaggagagttggagtatattcttttctttaaaaagagatgagtataggatatagtcttcctgagactgtgccctctgtttctcttctttgaatataaggcagggagaaaaaagatctccctgctcagtccagtggagcaatattacatgaaggttttattcagctggttacaaaacctatatcaatgactgtactcagaggtatgtatcttaggtccacatgcaagaaagggttcttttaatgtgaaaccaaatgcacagaaaaaatgagccaacacaaacaaacacaaaatgcagactcctaaacaaaggattcatgctcccaagaaaatatggcaacattctgaaatgcaagaatgctttagaaaatatcaacttcacagcctcaatatctgaatgggaacttggctctatgaagctattattggaagagacaaacctgagatgccatatgaaacaggttgttctgatgccagagggtgcattcttaccatgaggtaactctgcttcttacctagagctcagcagaaatagtgcatgactaaggaattctatacccagctagagtgtcatatgtatgtcaaggcaacaggaagatattttaacatatgcaatgctggtatctcttccaaaagaagtttactcatggacccggcatggtggctcatgcctgtaatctcagcactttgggaggctgaggcaagagaatcacttgagatcgggagtttgagaccagcctggccaacatggtgaaactctgtgtctactaaaattacaaaaattagccagacatggtggcacgcacctgtaatcgcagctactcggcgggctgaggcatgagaatcactttaacccgggaggaagaggttgcattgagctgagatcacaccactgcactccagcctgggtgacagaggaagactctgcctcaaaaagaaagaaaattttactcatagatggtatttaggtcatagaaaaattgttcaaaatgtggcattctaagtattgaaataaattcatcatgaaaatatgttgaaattgttatataggactaaattctaagcaccaggaagggacaatcactaatcaaaaatgaaaacatgaatataagatttttaaaaagtacattttgaaaaaattttttcaatatgaaatgtacagaagacataagcacattcttgtaaacacttaaaaattacaaatgctcatagccatgcttattgatgaggaaattgagggtaactaattaagtgaaatactggtttatagctagttatacagatggctgatccatagtccattttctacttggagttttatatttacatttttgaaaatctgcagacatctttaccactgaaaacttggtattatctgcaacaaacttatgaactgcagcttcacagcctattgatcaggcaaaaataaaaaagataccaggtgtagaaatactcagtttactggtccaaaaatatttcggatgattaaggcacttgggttggtgattaagatcttgtgaagaatgacgcagctgtttgctaggaagaagtgatacaattgcaaccattgctggtgcaaaatgtacatgccaccatgcatgtactaaaaatgtggctttttcttgtgtgctggaaaattactataaaaatttaacattttaagtgttttgcaacatctttgatactttaattgcaacttcctctaggaataattagatgattgatagagttggtaattgtagcttcaggtacaattgtgacctttcagatgaagctctgagcacgatcgattgacctcttctgcattaagtgatttcattaacttccattatttctgtctcatttttattagactggatttcttctcatattagaagagaaaaatttatcataagtgcagtataaaaatgtaaaatatgtgatactatcaaacataaaacgtatatagacactgaatgattgtatagattatctgcaaattacaatgagactgtggaaatatttatatgaaataagtggttctgcataatactcttggcaaaatttgcaaaaataaaaatttcagtgagaaggtaatggaatggttacaaaagaaacatcatttcggaccataccatgttatttagggatcatctttttaaactaaaaacatgttagtaccttctgaaaaagttataaaacatcataatttcattcattacttttcaaaatatttttcaaaatattttttattttgggtgtcttcccatttggaaaagaaaatgactttataaatattgtttcaggaaacgtctcataacttattaggttgaaacataaactatttcctccttttatttaaaataagccacaacaaaatacccatgctgacattaataaactatctctcattctatgggatttgtttctctttaaaacattcggtgaaaatattgaagatatctggagcattcttcctcaaagagctattaggaaaatatgtgatatactaacaaaattaaaacaaccaccatgaacattgggatgcgcaacactgatattcaacaactaatattttctctgtttcccctgtctctgtgtgtgtgtgtgtgtgtgtgtgtgtctgtgtgtgttggtgtgagtgtatgtaccacttttgctaaaccttttgaaattaagttgcattcaacacaacagttttcccacatattataattcagcatacttcagaaataagatctttcttctatgtaaccacaaccaggttagacactcaagtaaattagcaatagctaatgtgttttcttaatcggttattgaattgagtagagggctgagttagtggggaaataataaaactctccagctttgaggttctaggattctaccatattgtacaaaaagtggtgcaaggttcatgttttgattatctgttgttttacataaaatgttcttgattttgagtatggcagtggcattgaacagagaatagatggacttcattgtcaggtagttctgtgttccagttctatgccagttgtaagtggcattaggcatgattttaattttgttaacctgagtcttcttataaaataaggatcacacaataatacctacacgttcttatataattagagaggatgtgaaagcatttaaggagatggcgttgcacagcagaaagaaaaatacaattgtggaatgaaattgatctgactttaaaatacaggcataccatatattggattgtgggccaaccccttgaaactctgtgattgttgcttttactcctcttattaatttttatgcttaacagcattcattgttaatcagaccctttgcttttacttcattttttagtcttctggctattgttattgttgggtgaaatgggtcagttgtcccgtgttgatttataaacatatcattggagtctaaggcacttttaaaatttgaccatctttagtgtgccggtatggagtattcattcctttctgggaaaatgtagtgcatttgtgcacttaattcaggcatctgattcacatgcttttaaaaactattaccaatgtgagtttcatctccaagtccatttcttagtcaatatgatgtattttggtgttgtttctcctagtgagtgaattggtagactatatatatataatatatatatatgaatgaatacatatatatcaaatatacacatatgtgtgtatacacacagatacatacatatacatatatatacacacgcacattaattgctttgcctgttaaaatctgtcttgaggtccatgaaaacaggatccgaagcttttcccctgatatgacctcttactgtctcctctctttgagtgcgaataaaacctgtgatcataatgcaatgtcacttccattattatgttactaataggttgactttaagaggttattagagccagtcttagtggcttgtacctataatcccaatatattgggaggctgagatgagaggattacttgagcccaggagtttgagaccagcctgagcaacatagcaagaccctgtctttaaaaaaaaaatcaaccaggtgtgatggtgtgtgcctgtagtcccagatagttgagaggccaaggcaggagaattgcttgagtccagggggtcaaggctgcagtgagctgtgatcatgcctctgcattccagcctgggcaacagggtgagaccctatctcaaaaataaatatatcaaataaattttaaaaattaaaaaaattaaaaagaagtgattagatcatgagggctgtgtcatcataaatggattaataccattattgcaggagcgggtggttattgaggaagtgagttcctaatgagttcagttcatttttttctccctgtcttgtgtgttcacttccaccttttgccttctgttttgagataacccttgccagatgctgacactatgctcttggacttcccagactccagaatcataagccaaataacctctttttaatacattccccagtctgtagtattccattataacagcagaaagtagactaagacaccacccaaacaagatatggattttgtgatatctaactgctacacttcctttctactctctcaccccttgtgcaatagtttccaccggtcctcagaatgaagatcagaggtatcatgggagacctcatgtcagatgctggagtgtcttaaaggagtcaattctttcacctcccaagtataaaaggcacagtattttattggagcagatggtatgttgtggtcactgagctttaagggctggatgtgtgaagaagtaagggagatgctctgatattacaaagtatgaagacttgttaaaaaataatagatcatcagagatcaacaactttatcaaggttgtgcttcttctttactcactacagcaagaatgacagacagcaataaatggagacttttaatgttatcatcctgggaagcctattaagttctagtggtattaaaatagtagaaattggttgaattcctttaaggtgcatcttttcataaattagttgactaattgagactccaaacttttaaaataactgcagcactttctaaacttgggctgaaggaattgtaagagagggatttggtattcccacaatgtcatttattattcagtttcgacttggtacttccatacctcactgcttttatttttctttttcttaactcaacacaatgaaagccttacaaattttaaaggaagcaaagggaataccagtgattaagagagagcatatccttaaatttgcaaagcagtaatgctgttggcatttgagccaaggctgtaaaaatctactttaaaatgcttcctagttcagtatttgctgtatccatcaattgtttttaaattgaattactgtgattcaaataaacacatttcctagaggagaaagaacataaagttttaagtaaaaaatagttcaattcagggcctggtttcatctcttactatctgtgaatttggacatggtgtttaactgctcttggcttccattccatcatctctgaaatagcaacacctgcccaacaggataacagtaaagattcaatgagatgagagaaataagatacatttgtacactgcagaatgcctcaaaagcagaaggttttgtctttattatagcacttgtatatctgaaataccagtttttcagcatacacgtttatttaatgtgtgtttaatagacttctaacaccagtccaatatttttagcatatgtggtatcataatgaaaacaaaatcaaagatactcagtttttctaatagtttggcaaaactttagatttgtggtaaatctttgtatatttatggactgggatatttatagcaaccaaatgtcagctgtgtaagtaagaaaaagcaaatgtagctgcccacgacaaagaaacttcaagcctcaaatgtcagtatggccaaaggtgagaatccctgctttaaattaaattattggtatataatattgaggggttgattaagtaattaagcatggaatagctactaattgtctttattgtgtaagtgctagagtgaggtgtctggagggttactggttccaaataacataagaaattcaacatgccttcaaggagcatatgatttctcaaaagatctttttgtgggattgacaggagttttgttttgcttctgagtatgacagaggaaggcagaaagaagattcagggctggactgagataggatctccccattcatgaatccatttaacaagcattcatagagtttatgttgtacagaagtaataacagattaacaaaatctggaaagtcccacggtatatggaaaacctgagatgatttagttatttctctactgtcagtatcaaaagctactgatctgaaatatgggaatgtaaagcatttatcacgtgtgtcacaaaataaagtgaggagtaaaaaataaaaagcttttaatctaggaagcaccaaccaatatggaaagttttcatgctgatagttcatcccacaatgctagaagaaggccaagattctcctgaccgttctacagagtccacattgtttctctcactccacatggatcgttttgggtggctgttttgcttttaacatccaggcactgagtgtattcccttaatagaatgattctgaaatagttattggactaattcattgaactcgtgtgtcacaccattaccattaaggaagtctctcttctgcttgatatccagggcccaaactctctcccgtttggacttagaaagttatatattttcccaaagtatgcttactctaactgtcttcatattttcttgaaaagtcaatcaatgagaatcacaagaccatgttaatacatgcacatatattaaatcaggggtaatgacatttgggattagagatttaaaagtatgtatatatcattacaacataagttttagctcaacgctgtgagctcaatgtttacgcttctcaataatttttagtgctatttattttttggctgcttttaattctttctcctggggtaacacagagcaaaatcgtgctcgatttaaaaattctttcaaatgtttggaaatagtgacttgtatccatgttttctttttgaactaaaaagcctaggcaacctaggctttttctgatgcaataatcacaggattatacttcctttcattgattttttatttttgtttttaggagttttgccagagatgagtcaaataccattcagcattcaccttagggaaagctcattattccccatttgttaggacccctcaccaaaccacaaactgtgccactgaactatcagttctggtgtatgtgagccaagagaataagggtgcatacagataattgattttttggcatattgatggaaagactgttgtgttacactcctcaatccctgaggaccaggatggagtgtgtgttaggtgcaggctgatttctgcttaattggtgtttttcctctcacttactcagcatttcgctttacatccgaatctgacaccccgctctctcccatttgtccatctgtctgtagaaggtctgcgtgggagaggaaccaagccagccatctcatggcaagatccatggttttattgcaggaagaagcgtctggccatgtctgataggttttagacacagatggtgggagactcctttccaataacataactgacttccagtgggaagaaataaaagttggttccaggtgagaatgaaaagaatttttatctgaggaatacaagtccttttaaatgatcagccattaaaatgagacagcaattgcatcttgcttctcccaggagcaatgtatttatctcttgaaactactgtctattgccatgggagctataaattaacctaataatgctgcacctcacactataacccacagcctatagcttgacaacatatagtcaatcacaaatcaatgttatttctgtaaacaaatgagaatttctgacaaaaaactttgtatcagctcactccttgtccatctttttggcctttgaaatccagtcataactgctaaccatgagagtgtacattcagagcagtctgaattttttctcctggtttgcaatcttcaagcttggcccacatacactctctacttatattaattttgcctacactttttccttttaggtcaacacatgttaccctttatccaaagggtctcattaagagatgaacgatataaatgcagctcaagtgtattataattaattgtttctgtatattatgatgttttgatatcttcaattgcttctctggctagggagggatggcccctcctggggtgagccaactcttagagataacagagagaccagtcaagggcatggctttgatgtgcagactaaccggtccagaaccacacctcccctagggagcccatacaccccagagcgcattattcctctgccttaatcatcctggggccaggggccacgaaactagaggccatccctacagcccacagtctgcagaattattcaagcaagtcactcctaaaccgttcaccctatcctctcctgcctttcccacagaaaccccaataaaggcagtgccttaaacattcccttggcttctggcttctgcctcctgccccatgatggtgtctttcccaggtggttctgtgtagcacgaatatattttatatataaacacatatacaaatatatatcctttatagataaatatatattctttatattctttcttaatgtctagtatgtgttatatatttgtatactgtatattttaatatatattatatatttgtatattgtatattttaatatatattatatatttgtatatagtatattttaatatatattatgtattatatatttagtatataatatatttgcatattatatattttcatatatgtttatatattatatattaatagatattatatatttatatattctatattaatagatatatttgtatattgtatattttaatagcaattatatatttatatattatatattttaatacatattatatatttgtatattgtatattttaatatattgatatattatatattttaatagatattacatatttgtatatggtatattttaataggtattatatatttatattatgtattttaataggtattatatattctttcttaacttttaaagaacatataccttaatatataatatatatatattctgtcctaatttttgaagaaaatatataatagactttgatataatatatatattctttcttaatttttaaagaatacatattatatactttaatatataattatattctttcttaatttttaaagaaaatataaccttgaaagtcagagaaaaattgcaacaaaaatatttattcgtgtgtgtgtgcatgtatgcatatatgtatgcatgtattatatatatgcatatatacgtatttatttatttcgcggtgtatgctgacagcaaagaattaaaaagaacttgaggacattatccgacttagtgtatgagataagtgatattcagggagttgcttgcaaatggaaatctaatatgcttttacaaatcccattatgaagtctcctagcgcatcatcaaatcaaatcttcttaacagcatttaacgctctcaaccaaccctctcaacaaaggggaggaaggtgcaggctgcatttggtacaagcctgcacttctcctccttaatgccctactgcaattttgttttgttgtttaaaataattgcattgttctcattaatttaattcgtagtatataaataataccattttaactttacatagccatataagcctttgtttgaagtcaaaaaaaattttggctgctaaacttgagatagtgttggtgatagctgctccctgattcatgcagctctctgtcatgagctttaagaggaggtggaagatgttgcaagtgccatggaaaccaggtccacatcttattctccattgcacacaacaccctatgctgagccaccccaaataagctcaccaggagcaactactgacttttccagggtgcacctgctcagcatttcagtggtcgtttctctgggcacacatcctctttgtgttttccacctttcttctttctttttttcctctttttttctttcctcc[132 bp omitted]ctgcagcctcgacttcctgggctcaagagatcctcccctctcagcctcctgagtagctaggactacagatgagtgctaccatgactggctaatttaatttaattattttttatcgagacaagatctcgctgttttgcacaggctgttctgcaggtacagaaaaccaaatcccgcatgttctctcttataagtggagccaaatgatgagaacacatagacatatagaggggaaagacacacactggggcctactcgatggtgaggggtggttacttgaactcctgggctcaagtgatactcctgccttggcctcccaaagcactgggactataggcttgagccaacatgcctggcccaagctagtcatattacatccaacattttgtttatttatttacttatttatttacttattttaacttttcttttaaattcaggggtacacgtgcaggttcgttatataggtaaacttgtgtcatgggggtttgttgtacagattatttcatcctccagatattaaaccttgtgcccattagttatttttactgattctctcccttctcccaccccccaccctccagtaggccccagtgtgtgtcgttaccctctatatgtccatgtgttttcatcatttggcttccacttagagagcatgcggcatttggttttctgttcctgcattagtttgctaaggataatggcctccagctccatccatgtccctgcaaataacatcatcttgttcttttttatggctgagtggtgatccatagtttatatgtaccacattttcgttatcaagtgtaccattgataggcatttaggttcattccatgtctttgctattgtgaatagtgaacgtacatgtagaggtgtctttatgactaaatgatttatatttctttggatgtatacccactaatgggattgctgggtcgaatggtagctctgtttttagatctttgaggaatcagtacgctgctttccacaatggctgaactaattcacactcccaccaacagtgtataagcattcctttttctctgcaacctcgccagcgtctgctatgttttgactttttagtaatagcctttctgactggtgtgagatgttgtctcattgtggttttgatttgcatttctctaatgatcagtgatactgagctttttaaaatatgcttattgaccgcgtatatgtctttttttaaaaagcgtctgttgctcaggcatggtggctcacacctgtaatcccagctacttgggaggctgaggcaggagaattgcttgaacccgggaggtggaggt[134 bp omitted]tttctggtaaatttgttgaagttccttatagatactggatatgagacctttatcagatgcatagtttgcaaaaattttctccgtctctaggttgtctgtttattctgctgagtttcttttgctgtgcagaagctctttacttaattagggtccattaaatctaacattttaaatcaccatttcccatgaaagttagtgagtgtgggctctaactccaatgcgttttttacactttctactcttgtttttcctggagtttttagagtgttatttcacagttcatggactacaacctttccagcattttctgcataactttctgtttcgctcaaaagattaaaagaccagtttaccattacgaaaggaaaccctaacacccttcttggaaagttacttgacatgttgtgtaattaaaaaggacaaacaaacattggctttctcgctctaatttattgagttgcaagaaatagaaattgaactcaacagattggtaatagaaactacagggagaaaaagtgggtgagtctttgaatgaataggtttggagaacaatgggcctgacaaagttacaacatttcctttgaagcctttttttttaatgctccagtcgtagaatgttgaataaataaaggtatattgaaaatccacaagaagggttatcatattcaaattacaatttcaaattaaacatatttcaagttaaaatgaacatcaaattaaaattaagcaaaaaataacatgataatgggataagcttacaagtgtcatgtctggttaccagggaaggaggaaaagagatgggaagctactgcttaatgcgtacaggctttccttttgtggtggcgaaaatgttcaagaactacgtggtgttggctgcacaacattatgaatatcctgacttgtcacaataacctgacttgctgcctgtattactcagggttcccaggagggacagaactgataggatagatgtctacatgaaagggggtttattaaggagaattgactgacatgatcacaaggtgaactcctgcgataggctgtctgcaaactggggaggtaggaagccagcagtggctcagtccaagtccaaaagccgcaaaagcagggaagccaacagtgcaggctttagtctgtggccgaaggccagagcccccaggaaaccactggtgtaagtccaagagtccaaagattgaagaactttgagtctgatgtccaagggtgggaagcatccaacacgggagaaagatgaaaggcagaagactcagcaagccagcttatcccatcttcttccatctgctttgttctagctatgctggcagccagttggatggtgcacacccacactgagggtggatcttcctcctccagtccaccgactccaatgtcagtctcctctggcaacaccctctcagacacacccagaaacaatactttaccagctatctaggcatccttcaatccaatcaacttgacacctaatgttaaccatcaccctgccttaacctgtttttggccatgctttctgtagccacacgatgatataaaagtattggccatcagctcatttttttgagttttaaagtattttgtgtgactcctgtgcatatgtgtgcacataatacattttgtaaggcttctttttcctgttaatctgtgtactatccatttgtttatagactgattattgaattctagggactaagcaaaatcttccccttggcgctctgaaggtttgctgtaaatcagctcacaaaaggcagattaatcagagaaaaggcacacacatttattaacaagcatgggggagaattacagagggatatctgtaccacgcaagagggtacagatgtttatatgcccttcttcttaagggaaaggaagatggggaggtagggatgattttaggagggtagtacattatttttcgggaaagtcaatgggcttgaagaacatacagtggcctggcacaaagtccgttgagcccgcagagcaaacaatggtttataagtctattcaggcatgttgaccgacttcagtctttcttcctgagatatgagttcagttaatgaaaattcagagaagggacagaggtcattgctttcttctttggtgcatctagactctggcagataagggaactcagagaacaacttcatcctgtgcatcgagagagaggattgagagacaggggcgatggagcatcacagagaccttgaggcttcttctgcagttcaacatatcaaagcaccatattttggggtattggattcatgagccccaaaagaacctccaagagaaaaatttaaacttctttacgtggtcatgaagagttgcaacttttgcgatttaacatcgcatgggagccaggaagacttggggatgaaattctcaatccacctcttcttctagacttcagtacatccatttattaatctttccagtgataactcagagggaggctcaccccagagatgccataagcagtgcctggacctctgaggtcaccagtggatgtccagaacaaatagctaatatacatatagagggagatggatatagagggagatggatattaataaacaattacactaattagtgttggcttgcagttatggtcagtgcaatgcatgaaataatatgttagaatttcagacagtgcagatggctttaggtagtattgtaaattttgtacgcaattgtagcttagatattatcgtaagtcaagactgtggttcaaagtgcaagttgttctctgcatccagtctactaccataatgagaggtctgaaaattattattatttttaaataaacaaactttaatttttagagcagttttagatttatagaagcagagaatgaagtgtatggagagctcccatatactcccatagaagggaaagtacacagttcccatatgacattttctttttacaattattttattttaatttttaattctaagttttgtggatacatagcaggttgttcatccccttccctagattcctctcttattaaatatttttttacatgctagtcatatttcatccaatttttaaatcatattttacatatactttgtttggattgcttcttgttttgttttatttttaatcgacttaatttttaatttatttttatttttatgggatgcatgtgatattttgctacatgcatagaaagtataatggtcagatcagcataactggaataaccgtcatatcgaacatttttactcgtgtgtgcatgtgttatgatcatttcaaagcttcttttctagctattttgaaatctacaataaattattgttaactatagttgccttattgtattatcaaacgatagaacttattccttctgttttactctgtgtttgtaccttttagcaaacttcttttgatttctcctccctttccccttcccagctctggtaagcaccaatcaactctctacctccatgatatttaccactttcttttttttagctccacatatgagtgagaacacgagctatctatatttctgtgcctggtttatttctcttaatatagtgatctctagtttcacccatgttgctgcaaaaaacaagattttgttctatttttatgactgaataatattccatcatgtatttgtgccagtttcttttttaaaattacttattttatttttaattttttaaaaattttcattttaattatttgtgggtacatagtaggtcatgtaccccacaaatataccacattttctttatccagtcatctgttgatggacacttaggttgattccatagcttggctaccgtgaatagtgccgcaataaacacaggagtgcagctgtctctttaatatacttatatttcttttcttctggatatatgtattcatttctatttatacatatttatatgtctatttattatatatattgtatatatttatttgtatttatatatttattatatatatttatatatttattggagatatacatatatatatatatgtatatttcttttcttttggatatatacccagcagtggcattactgatcacatggaagttctacttttcatttttgtgtgaagccccatactgtttttatagtgcctgtttttgttttttttttttttcattttccatagtcagatactgggctttaaatattttaaaatttaaccatcagacatcatgtttgaaaaccaacttcaaaatctgcactgacatcattatttttgcttcaattttactcattgctgtctcaaacaacattgatcaaaaacattgatttttttccctcaaggaagatcaaattcgataattttaaatgcagaaagattccatgttgcaaaggatttaagcttgtatatggaacataagtacaatcttttttattttggtgacctttcctgaagtttcttatgaattttgcaattttttgtgagcattaactaaatgctatttactgataggaaaactggttgtttctcagttcataactcacctatcagagttagtgccctttctataaaaggaatatctttttttccaaagtggcaactttagctgaatgtatgcactgtattctaacatgctatggtttaaatgtcttccgcaaaattcatatgttgaaaccttgatccccattgtggcaatgttgggaggtggggcctcatgggaattgcaggagtgggtttcttagaaaagaaagagtttagttcccacttgccctctctcttgccaagtgatgccttttgtcatgtcatggtataggaagaaggttcttgcaagatgccaatattttgatctaggtctttccaacctctagaatcataagccagtgaatttctactcattataaattacccagtctgtggtattttgttagcagcacaaaattaactaagatataccgctaggcagataaaaatcttagtcttcagaaaacattctcttttaagatattatcataataaaaccctctggggccaaattccatcaatactcactgtctttttccttcactacctggaattcacagtaaaaggatacataaataaaaggatattttgttgagtttttgtttcattgtccatattctattttatttatttatttttaatttttatttttttgagatggagtctcgctttattgcccaggctggagtgcagtggcatgatctcggctcattgtaacctccgcctctggggttcaagtgattctcccgcctcagcctccggagtagctgggactacaggcccgtgccagcatgcctggctaatttttgtatttttgtagagatggggtttgtacaaac[131 bp omitted]agctaaactgctatactgttcacacattctgtatatggcagtttggatttgaggtgcagttcttaacatttgaatactgtgacaggcaccctgcaaatcattatttctaggtgtcagtctcagtactgaaggggattctcagtaaataaatccttggaaattgatgcatggtaattaagtgtgtcagagactaattatcagaatgggctgggtctggccaaggtcatgggtacatgcaagtgcatttgtagttgcactggcataaaatgatctagctcattctcttccatgtgttttcttttcttcctttttttttttttccagggcggagtctcactttaacgcccaggctggaatgcagtggcgcgatctcggctgactgcaacctccacctcccgggttcaagagattctcccacctcagcctcccgagtacctgggactacaggtgtgcgccaccatgccaggcgaatttttgcattgtttagtagagatgaagtttcaccatgttggccaggctggtcttgaacttctgaccccaacttggcctcccaaagtgtctttcatgtgttttcctcctcctgtaaatgagaacactttcttaagaaataggttcttgaattatattttctaaagtagaactttgtattcttacctgatctgattctgtgttttcgaaggccctggagagacctgttgagaatgcatgtgtgtttcagagtttggaaacagttctagatcctaattgtgaattcctgagagtgcttcattgaaaacaagtgagcatatgtttttctgcaagaagaggttaaactgagaaattgttttggtataaaattgtggaaccaaagttatggaaagatgaggatacacattatatgttgaaagccagctggtgttttacccactgttattgaaagtcaggaaaccccgtgtggctcagcaaatattctgccttggcagaggaaagaaaacttacggacaaagcaaaggagaggctaaaacgctgaatctgtgtttctttcttcagagctgctctgggtcagcaccagaaacattactaggtgattaatgggattaattgatgaaaaagatttattttaaaaggtcttagcaattagtgatggccattatctagttgcttctcttttctgtccttctttcctagcttagaccttttccctttaggacataaacaccttatgttggcactggaaaatagacaggtgtgtgtgttcataaaattgcatccttgctgcctctggttctgaatatcttttaattatttagtttttataggactgagggctcctgcaagcttaattaaagctctaatttcttctgggaaatgtagatgcacttgttgggcaaggactgaaaaactccagtgaatatatttaggaaaaaaagtataatgactctttccagagttgtggggatcagagtttaaaacaaatgtgcacaacagcagaacaaaaaagatgttcctctccaggagttcagagagaatttagattaattccacttttattaattcttgcaagttacgtttgacatctgctattttctaccattataatatctagttaatttcatctttttttcctactcctgcttctcctcttctttctcttcctcctcttctccttctcctcctcttcttctctttctcctttacttttctcttcttttctggctataaaaaaacacagaatcgtgaacatacaaggaaagcgaggcaaattctaacaggtaatccaggaagcttttagaattgacataaagaaccatatttgcagaaactttctcgtcctaaaaccagatggaaacaaaacaaaacaaaaatagagaaatgcagtaaaacctcatgaagcattttatctggagtattcgaacacccactggttgtgtgatttgctggaaggacttaaacagttcaatgtaagattatatatgtagctacaacttattaagtgaagaatactgtgcagaaacagcagggggaagatttacataggtggagcctagagaggtcaaagtcacactttcttgtttttcctctgcaaaaatcacatggatttgtggttttttttctgtctgtgaactgcagggatatttccttatgcgggaaagcccatttgagacttagagaccaaagttcttaaagggagcttgccacatatgcacatacctgccctgtagccaaccatggttcagacccaaagcaggtagcaggtgaacatatcatgaatctctgtgtctcatttcagcacgctggcagctggtttatcttatccactccttcaggtatatagagtaacatcttacccagtaatccagtgaacatttcattagattcatttctagggtttcaccaggagtcatcaccgtggctaaagacataagaacggagagaaatgtgaacttcctctgtggtgttgtctcataagcaaccatgaaacttaaggaaaagtgttctcataatagctcgagctgaactgggtcgaccagagccttaacatgtaggactaaaccaaaaaatatctgtactacctacaatgtgctgaatgtgtgtgtctccccaaaattcatatgttgaagccctgattctcagtgggatggtattaggaggtggagtttttgagaggctattagattatgaggttagaaccctcaagatggaattagtacccttataaaaaaaagcttttcacttgaggccaggagtttgagacaagcctgggcaacatagtgagatcccatgtttgcaaaaaaattttaaaaattaactgggcatgttcttgtatgcttgtagtcctagctagttgggtggctaaggccagaggactgcttgagtccagaagttcgaggctgcagtgagctacgattgtgccactgtgctccaggttgggtgacagagcaagaccttgtctctaaaaacaacaacaacaacaacaacaagaaaagctgtgagagagtttgattctttttctcttcattgtgtggagaaacaaccagaagatagctgtctgcaaaccaggaagagagccctaaccagatgttggatctactggtaacttgatcttgaacttcccagcctctagaaatgagagacatacattgtttaagtcatgcagtttatggtacatttgttatggcagcccaagatggctaagacattgccagaaacaatactattaggaagaaccttcttttaaaaaagcagatgaaggtgactatagactttcaaagaaacactgaaatattccgcaactgcataccatggtagtggcttaattagtacatattaaatggctctagggacagtcaaactcactatactaaggatctctaaggtttaagctatgaaagagagactttttttttcttttggcttaacctatttctcacagttggaggaatcatggaaattaaggtgatggtctctgcagtcagacacaatcagatttgaaaccgtgttccaccattagagctgtgtgatctagataagttatagatcctaatcaaaattgttttctcccacgaccaataacagtatggatcatgcttctcttgtcatgctgatgggatgattcccttatttatagcacaaagggcagtgagtcagcacatggtgtgtgtcaacaaaaacaaatgccaaacagatgagagataaaaactgtagacctgtaagaaatctattctggggaaacgttatccccaaataagaaaagtagatggaaaacaaattttataaagtgttatttctgtaaaagtgagtggggacaaaagaaaagagagaagaaataaaggacaagaggatatgaccagaattgagataaaaaccaagttggagaaggtgatgaggaagtggggatgcctcaggctggaggatactacagcagacgtgtccaagggcagaatcattccatgatcaaagacagctggagtcaggcatacggaatgcagtggccaaccacaattacaccaccaatgaaagatggcagaaatgcctttgcaaagcaaatgtgactggggagttacaacgcaaacaaatgtaatgaaacatatgtaaaaacaccataaaagaaaatcttcttaagatgaaggatactttgagtatatatcacaatgcttttctattttctattaagtgtaaacacatattcttatggtgctgttgaatattagacaaaaaccaacagagattcagacagaaacagaaattctccttcaagttaaaaaaaaaaacaacaaaaaaccaaaacgctcctcaaacttctgagttatgtaatgtgtcagaaaacagtggaactgggataagaggtaaaatacacgtgttttatatttaatcaacaggccactcaagaataaaattgataaaaatttctgaattgtgcaaatgctgagggtacattgttcccattaactgtggcttaaaaaagaatctaaaaatctatttagtaacttgttttgactaaattaaaggtcaattgaaatgatcatctctaagagttatattttggaagtagttggtgtctcatgatgttactataaatttactctctcaattaaccttttctaacatattactattgtttgaataatagacacttacttttgcagattaattttgccatctgcctcttcttgatttttctgatgtttgagtcataattttgttttcctttttttttttttttttttttagacagggtctccctctgtcactgaggttggaatgcagtggtgcgatctcggctcactgcagcctctgcctcccaagttcaagctgttctagtgcctcagcctccctagtagctgggattataggcatgtgccactacacctagctcacttttgtattttttagtagagattggcttttggtatgttggccaggctggtctcgaactgctggcctcaagtgatccatctggacacctcagcctcccaaagtgctgggattacacgtgtgagccactgcacttgacccatttttacttctgatttttttaggctcacagtgagaacatcttcaaataatggtgactttaccctttttcttttttatcactattattttatttttatatgcaaaaaattaaacttgaaatagttctagatttttttttctcctattgttgggatatggctgcttcatcacacaaggggacaaaactacattcacatcagtgaggacccagggcagagttcaagtggcatagcctcaacttagcatattcgaacttggcactctttccaaaattaccacaggaagaaagaacaaagattcactgcaaataaatgaactatgatacaatgttctttcaaaaatttttcattttgcaatgaaacattttgcaactgtaattatatgactgcctgctttaggatattttagatgtgtgtgtgtgtgtgtgtgtgtgtgtatatataatatattaagtatatatatgtaatatatataccttagtataacttttgctaatacagtagtacaagctatttctgttctacaaattttatattttatagctacaagggtgaaaagtaacctacaacatttttatgtcacatatccttgtatacaaacagtatttattgaatttgagccaaaaactagaagtctttagttttagcacttgaatgagcttccttgcttctgcagccttatatgatacactactcacatttccagagttcgccattactcattactttaaacttggagaaacaggtgaacccaaacttttgattacaatttttatatacaagttagataacacagctcaataagacagagctatccatcctaagcccaacacacaccttctgtactatgttagacaagctttgagttttctgtttttccttacaaaataatatgcaaacttagaagtaactggtaaaactgatatacaggatgtcaaaggaaaggtgacatttttctgttggttccaaaaaggttcctgcaaattttgtactctgctttgttctctaactatatgtctgttacatgcagaaagctctttcacaggaattgaactatttaaatcatattttacattttattttacaaccaattgtgtg[137 bp omitted]tggtgaaacccccctctctacttaagatagaaaaaatttagctgggtgtggtgccacctgcctgtaatcccagctactcggggggctgaggcaggagaatcgcttgaacctgacaggcaaaggttgcagggagctcagatcgcgccattgcactccaacagggcgagactccatctcaaaaaaaaaaaaaaaaaaaaaagcgcacatttcttggaaccattctcaatagtattaccttttctgttttctttaatttggaaagtaatagtctcaagttatatttaattgttttcgctgtgccttttgcagacaattcacataattgaacattttgaacatatatatattccccatttatttttcttttatataattcatcaatttttacccttacatacttatatctttctgattaaaaggacaattaaaattcataggcataatttgtcaaatctaacatttataccactcatcagaaataacttaaatactagttaccaccaagtagcaagaggaggcagttccttattttctcacgctgtaattgtaaaggactcctaaataagttccagaaaaaaaaaaaaaaaaaagaccatgggagcttctcatttcatccttgggaaagtcttggatgtgtagggagcagaacaaatttgttgaaccaatacaataagagcaaagatcaatgagtcgaggcagaattaaatgtccatgacccttaaattctataaacagtaaatatggaagagaataaacaaataaaccagtaatggagtccaaccacaggaagaatcaattatgattaagttagactccgaaaatatacatagaatttaaaatcagtggttttaagtaaggatttctggctttgggctgtttcttttgtgcaccgaaaatgtgagttatctgctttattgatcatttatatttcaacagataatggccaaattgtgaaatctgacctgtggaatactttaaatttcttctttgttattaatcatccatatagacataaatttccaagaaataaagtactttaaaaacattaaaatggctacatataccatgggaactcaaggatgtaaagtagaaactggtaaaagttaaaaacagcgcatgaagagttaaacgtgcaatgtggctaattcctgaatatacccaatttctcatggactgcagtgctgccctgtctactgcaacaataacaaaaaagcatgtttgcatgtcatgaactggcacaggttattcaaggaaattacgtatgtacccagggagctattcaggagaaaggataggaaaaaagtcatgcaaaacagttttgctgtgtatagcaaattctccagaatgtgaaactcgatgctgagagagtcatttggaagcagtgtttctgcaacctagttaaaaaaccaaaagaaaactccaaacaacacaaacgcaaagcaaacgctagtattttccccatgaatactgcaatttagatatctgcttaccaccctcctcttttcatgtgttttgtgtgatggctgacaggtgtcctgataaacacagtgagataagacagaccagaaactagtgcctatgctacccattttcaagtcagaggaaaaactctaaaaggaaataaaaggaaaaaggaaaaggagtaaagcaagaacctcagctaaatctttcttactttttaaaaaagaaaaaattaatagcttacacacattttgttttcaagactatcttttacatgtatacgttgtatggccgggcacggtggctcacgcctataatcccagcactttgggaggc[134 bp omitted]gaggcaggagaactgcgtgaacccgggaggcggaggttgcagtgagccgagattgcaccactgcactccagcctgggtgactgagcaagactccttctcaaaaaaaaaaaaaaaaaaaaaaaaaaaaaaaaaaaacgttatttaaatagactggattttgcttttcatggcttaattattgagcttttaaccaataattgcaaagttgtgttttgttcccatatccaggataaagtggaagacccactctggaatattgctggttcttggcgtagaaggaaaggataacatggggaactggcttctaaaagttctggcaagatctgattcgcaattttcatctgcatgactttgaacaaaaggtgacaccaatggggaccagaggtgccatctaaccccaggaaaggatggcgattatacaaagatggtcctgagatatgcattgatggtatatacataatgctgaaacttctttaatctatttaaaattttattttggtccagtatttgccgcagcatcataaataaatgcttatctttctttataagaactcaagcccatgtgggatgcagtggtttataaaccagttctgtctgcactgaggaggttgtaaatcacagaaaagtgaattcatgataactttgcttgatatagtttggatatttgtcccctccaatctcacgttgaaatttgatccccaatatttgatatggcccctaaaaaggagtgtttgggtcatgaagatggatcacttatgaaagatttggtgacatccttgtgataatgagtgaattattgctgtattagttcctgtgagatctgattgttaaaaagggcctggtggccaggggtagtggctcatgcttgtaatcccaggactttgggaggccaaggcaagtggattacttgggcccaggagtttgagaccagcctgggcaacatgacaaaaccctgcctctacaaaaaatgaaaaaaattagctgggcgtggtggtacacgtctgtagtcccaggtaccttgagaggctgagatatgaggatcacctgagcctgggagtttgagactgcagtgagccatgattgcaccactgcactccagcactccagcctgggtgatggagtaagaccctgccaaaaaaaaaaaaaaaaaaaaaaagaaagaaagaaaagaaaggggggggagagagagagagagagagggagagagagagaaataaagaaggaaagaaaaagaaagaagaaagaaagaaaaagaaagaaggaaagaaagagaaagaaagagagagagcccagcaccttttcacctctctttcctcctctcttgccaggtgatgtgatgccagttcccccttcaccttccaccatgagtggaagcttcctgaggtccttactggaagcagatgctggtacccatgcttcttgtgtagtcagcaggaccatgagtcaaataaacctcttttccttatacattacccgtattagatactactttatagcaacatgaaatgaactaagacaccaactttcaaagaaaagattgagctaaatgagtattaatttggaagatccaaggaaaggattttgagtctcttgaggtgcaggaataccaaagctagggcagggggaataagttcagaataagaaaagagtcttcatgacatgtaactgtgacatatctgagtggccatggttccacctgcccttattgtcctaggaggtgaccagaccagacctcttcactgaatgcatgcaacagcacctggatcctctttcaatgtgcatactcctatttttttccctagcggcgtgtccagaaaaattagagaaaaatacatgtgcaatcctgtgttttgacacccagaagtccattttgttttaagttctatacaaatcaaacttttcaacctctttgaattgggaattactgatgctactccacccagcatgacatgttccatggacaaacactggcttgagtcattcacacaccagaatttcttgcttgattattatttttttaatgcatttatgttttatctatccaacaattaattctagaacaagtaccttatagtgcctttacattccacaagtaaactgacagtcacagctcagtgattgccaagagagcaacatctttttctggaagtgtgtgagtttcttatggttagtgtaaaaaataactgcaaacttagcatcttaaagcaacacttaatgatcttattatttaagaggtgagaagtccaacatggatctctctaggctaagaaggaaaggttaatggggctggttctcttctggaaactctagggaaacattcatttccttgctctattttatctcctagaggccacttccatttcttggctccatgacctcttcctccactgttaaagctagtgatgttgaactgtgttgtcacatctttggaagttggaggaacattatcctgactaccgtatgatgtgatgaatcaaaattaccatgagtccttggtcttgatttcttcacatttctgcctcgatttttttttctgtgaaagaatattatttggaagaatttttcatagcatgtactctaactcccattctaggagtggattactgaatttctttactcgtaccccagacatgtttccaccaaggtttttcaatcttgaagctattgatatttggggaaggttggcattttggacaggattagtctttgctctctctctctctctctctcgctctctctgtatgtgtgtgtgtctgtgtgtgtgtgtctgtgtgtgtgtgtctgtgtgtgtgtgtgtgttttggggacaggggttgtgctgccgtgtgcactgtagggtgttaagcagcatcactgacttctacaaaatggatgccattagcacctgcccaccaagtcatgatgacaaaaaatgtgtgaagacatcacttagtgtctcctaaggggagaggtcacctcagttgagagccactggtttacaagattttactgaaacaaagacacatgcatcagcctctgaccattgtgaatgagactgtccaagctatagttatgtgacggttaattttatgtgtcaacttgggatgtccagaaaactagtgaaacattatttctgggtgtgtttgtgagtgtgtttccagaagagattagtatttgaatcaataaacccagtaaacaagattgtcctcctcaatgtgagtgagtagtatctgattagtcaaaggcctggatagaacaaaaaggctgaagaatggagaatcccttctctcttctggagctgggacatccatcatctcctaccctcagacatcagagcccctttttcttaggcctttggactcaaactgggacttacatgattaactcctctggtcctcagggcttgggtttccattaaaaatagactactggctttttctggatctcccttttgaagatagcagattgagggacttctcagtcttcataatcatgtgagccaattctccataataaatctgtatctatctatctatctatctatctatctatctatctatctatctattatctatctatctatcatgtatctatcatctatctatccatcctatccattctatgtatctatgtatgtatctacctatcatctttcatctacctatttatctattatctatctatctacctgtctatctcctctaggttctgtttctctgaagagtactgactaataaaagatagtttactatgaagttgaaaagccattggtttagacataaactgaaagttgtctacacatacttggagagagaaaagaagactaggtcaacaagagagaggtgtttgggagctgtatggatgtctgttctctgttggtgttcaatgaaaatttcactaggcaatctctgtcattgggaggttgtcatgggtgttctgaatctttgcttatctcataatagacataccttatgggcacaaacaccgtttaagagctgaaaaccattgatgggtcactcattcctcaggtagggaaaaggtagtaaccagagaaatttcataccatgctagactgtgtgcagcagtccaactctatttttttaaacttttattttaggtttaggtgtacatgtgcaggtttgttatataggtaaattgtgtgttataagggttcggtatacagattatttcatcacctgagtaataagcatagtatctgataggtagttttttgatcctcaccctcctcccacccttcatcctcaagtaggccctgatgtctattgtttcctcctttgtgtccatgtgtacccaatgtttagctcccacttataaatgaaaacatgcagtatttggttttctgttcctgcattagttagctcaggataataacttccatcatctccattcatgttgctgcagaggccatgatcccattctttttatggctgtgtagtgttccatggtgtatatgtaccacatttcccttatcagtctaacatcgatgggcatttaggttgattccatgtctttgctattctgaatagtgtggcaataaacatatatgtgcgtgtatctttatggtagaacaatttatattcctttgggtatatacccagtaatggcattgctggtcaagtggtagtttcgttttgagttctttgcgaaattaccaaataaacagttcaactcctgattgcatgaaaggagacctttaatacagggatatcacccaagacaacttctcagggcccttttctgttttactatacagttaacctttggacaatgcaggggttaggggaactgactccctgcacagtcaaaaatatgtacaagcctttcgtgtcctccataactcaactactaatagcctattgttgtctggaagccttatcactaaacacttgatcaacatgtattttatatattatgtgtattatatactgtattgttacaataaagcaagctgtggggaaaaaatgctattaagagaattataaggaagagaaaatgtattcacagttggttaagtggaaatggaccatcataaagatcttcacctcattgtcttcaggatgagtaggttaaggaggaggagaaacaagaggggttggtttttctggctcaggggttgcagaggtggaagaatatctgagtgtgactagatctgcatcgttcagacccacgttgttcaaaggtcaactgtgctagatagagagtttgtgttgggtaccaaccaattatagtagtttagatatgtgatgtctttcttaaatggggtgagaaactcagaactttttatgaacttcaaaaacatgttgtagaatatttgaaataagggggttatgcctcattcccattggcataattagcagaaaaatcttgcaactggcgaatgggtttctttgttatgtatgggcattcagtgactggcaaacagtcaatctaaagtgagtaatgagaaaagatgaaaaagagttataaatgcttaactgtttcagtgattttaattaaaacatttgtcatgcctgaaactaattagtaattacttaagctctttattatgtagtgctgaggaaacattactttgagtttcagagcaaatttgagtttcaggtaaataattgtttaagtcagaattaattagttcataaattatgtagtcacaagatcattttaatgaacttatgtttgttaataaatgcatcaaggccttcttttctacagtactaaaacgcatattgtttgataatattattgaatacaaaaataaaatacacaatgattttagatacattaaaatgtttctatgcatggtgtctatggtatctaagaatgaagtatattacttaaaagatattttagtatgatgataggcacattaaaagttcaaaaattaaaataagcttactcttttgtatgcttatatgaggagatgaaattgtaaaatgttttggaagtttagtatgtgatacaatgtttcaaaattgtaagattgcagatataaaaccttcttggagtacttgttagtttggccatctttcaaaggaagcaatactgaggaattgataaatcgatgatatggatcctagttggttcataatccctacctgtgaagcaggttgacagcgtactggttacttgcttgggtttggtaagaaagaatgcaccccctccttgcccagcacacacaaaattacataaagtggatttgttacttacagataggtagaatgagacaacagaaacctaggatttataataagccagatccccaaagcttgggaaagctgcctggggtgaacggaatctcagtggcatgtaccccatttgcacaatggctgagagatccctgaaaatagcttactctgtgttttataccccaggggaacatgatttgctgggataaagtcttgtaagacatcccgttctaggaggaagtggaacagagcctggttgtcttggccagtttcttcctatctcaggatattgaattctcagcacattctacaattattttgagaactacaagtgagaaagaggaggaggggtgaacagttgggtagctgaagccatctggggacttgtgctgcaccacacttatgtaaaacccaaattactatcatcataatttctctttgaggttcaagagtgtaaatgattgaattttattcgtgtcagagtatccatgtcaaaatatacattatcaataggtctttaaacagatcatagtttgtagaaaatctgtacaacatggttaaaaatagaagcaagataaaattcaaggaataagagctactgaatcatttgagagacagcaagaagagtgtattctgacatctattaattatacgtttatagcagaataggatattcatggagactgcatgcaggtagaaagggaatgtaacttccttatgattccagaactattttgtcttcttctgtatgactttagcttatttagttccaattaataaaacaacattttagtgcaatgctgtcatcttggtctcattaaaaaaaaaaaaaaaaacacctgttctgtaggtaaagacaacctttgttccaagttttgtgtttaaaactctttgtgttctttttcacggttgcttttctgtgaatgttagagggctggggcttaagtagggggaggacacaaagttgtcaggttgctccctggtttctgctctatagggagcttttctgagctttcattaatctggagacctctgaggacctgctggttccacccatgtggtccacatttgcttctgaagactattttctcattctagtaggtgctccaaaaagccatggccatctccccctgctgtttgggttccttctttgctctttctgggtctacacaatccgtaagatctggctgggaccaccttctcacactgagtgcattgagtttgccatgcaacccccatctacagagctaaagatttaaactgtgcacttgtttattttctatttttcttttttaagtctaggccctttacaatgaatcatccatactaaaaatatgtgggtttttcaatttctttttttatcttttcttatgggtcgaatggtatttctgcaaaagctatgttgaacttctagtatgtgctacttctgaatgtgacatatttgaaataaggtctttgcggatgcaatcaagtaaagatgaggtcggtagggtggaccctaatccaagaagactgatttccttataagaagaggagattaggacacagacacacacagaggagagggctatgtgaagacagaggcagaagttgaagtgatggggccataagctaagaaaagcatggagccactacaagatggttacttttaggtgtcaacttgatgaggtaaagagatgcctagatagctggccaagcattatatctggggatgtgctgtttctggaagagattagcatttaaatcagtagattgaagaaagcagattgccatctctaatgggagtaggcatcatacaatcagttgaaggcccagagagaacaaaattgcagaggaaaggtgactttattctctctgctgcagaggaaagctgagacatccatcttctcctgcccttggacatcagaactctagattcttggtccttcagagtctaagactacgtcagtggcttcctccagttcttaggcgtttggcctcggggtgaagattgacattattggcttccctggttctctaccttgcagagagcctatgggggacttcttggcttccataatcatgggagccaattcttctaacaaatcccctcttctatttctatatcgcctattggttctgttattctggagaacttgacaatatacaccagaagctgcaggagcaaggaaagattcttccctactgccttcagggggaggactgccctgcaaacaccttaattgtgaacttttagactaagaaacattgagagaatatattttttgctgttataagccacccagtttgtggcactttgccatgtgagccccagaaaacgaatcctcttctgtataaaaatgaaaaagaatgaaggaagaagaccaggatggtcccacactatttatagaaggattcaggatgaatgatttttctctatctactgtggcttcattttctttctttatttttcttttttgttacttccccagagcagggttattttataaataagaggattatcttatatcactcgtcattgggatcccatagatagtttactttcctttcagatggtatttagctcatgggcagcaaattaagcatttaaaatacacatcatgaatataagttgagttactgcctaatgcaagtgcttaaaatctggaagcattcacctttggatgcatgcatgaataagtgagttggttagtggctttcacactgtcttgctaatagatacttggtaaaactctctgtaagacaccacttgatgggaagaataggtgtcagtcctcactgtatactttttagttctgtggtgtcaatgaagtctgttcatttctctagagcccaattctgcacgaggtagcaggggagaaagcatcatttacctgtctccagtggaaagttgaaagagatacatttagaaggccacctccacaatggttattaaaaaatagatacatatagatgattgtctaataccaatgcatatgtgtgaggaggaggaaaataggagagagaagaggagatgggaaggagaggaaaatggaagaagagaggagagggggaaatgaatgcagggaaaaacatgagagaaagaacaggaaggatgtgaatattttgttttattaaaggaacgggggagtgtttagaatttgaagagagcaaaaagatatttaaaggactttggtttctgttgtttggattttcacttctgaatgtaaaatcttgtgtaagaaacctggggaataagtcaaacggaattgaaagagtaactataggaggaaagactaaaggcagagatgtatagctcggtttcagcctctctcagcacccgacctagcgaacgatccctatcctgagtaatcttgtttccctgttttgttactggcttgtctatgtaacatgttcttttttttacacatttgtttataaatcactttcccaacactcacacactgaccctcaaagtacaaactaagttccttgaagccatgagcttgattaattccagatttcttcccccaaaaagggcttggaacaaagtaaattctccattatcattagtttgtatttcaatcaacaaataaatgtgcatatcctttattggcattttaaaggttttcagactcaaagtacttattatccgctatggtttttgccagaagagtgagaataaattgttctcaatgagtagcttttcagcacaaagaaggaataaaaaactggtgtctttctgtagttattatctgaacaatcgctgtaattcaggatgggatagaatcattttcactcagccattttttttttttcttaaccacagccatcaaacaagaaacaatgtttctattacctaagggtatattagaatgtgtagactgaaactatgaaagcatgttggaaatttattactcctcttgctgctttttttttctttataaatacttatttatggccttgacaaattttccccaaagttcctttcatcttttggtagtgagggaaaagcgttatcccattaggtttgagttgacttgatttaggagtccaagtgtttgatctggctgcaggcgttattgatgtctctgaaagtgtattgtaaaacaaagtaaagtaattaaatggaagtaaaaacccttttaatggtaaaaacaaaattattaaatgactagacagtaatcaagtggtgcatcttaattaaataaagtgaaatgttttactttctttggaaggtctttagctggaaacctctggtatgggcaaacctgcttttcaaaaaacaagtgtaaaagcaatgctgctaaaatgtatttggtacctatttttaaaaaactaacaaaaattttatgtatttgagttgtacagtgtgatgttttgaaacctatttccacagtaaaatgattactataatctagcaaattaacatatccatcaccttacataattacctctgtgtgtcataagagcacacaaatctactctgttagcaaatttctagtttactatacagtataattagctatagtcaccatgctgtgccttagatctctaggtttattcattctacataattgcaactttgtactttaaccaacatctctccatttcccccacctccccatccctgattaccaccattctactctgtttctatggattcagctttttaagattctacatgtgactgagatcatgcagtattttttctttgtgtgcctggcaatgtcctccagtttcatccatgttattgcaaatggaagaacctcctgttttaaggcggattaatgttctgtcattggtatagaccacattttgcttaagtattcatccgtcagcgagtacttgggttgcttctaccatttggctattgtgtataatgctgctacacacatgggtgcacaaatatcttttcaggtagctgctttcaaagattttgggtatatacccacagtggaattgctacgctgtatggtagttccatttttatttttttgagaaacttccatgctatttttcgtaaggactgtaccaatttacatttccaccaagggttcacctttctctacaccctcacaaacacttgttatgctttaacttttgataatcgccatcctaacagatgtgaggtgatatcacgttgtggttgtgatttgcatttccttgatgattagtgatgttaagcaccattttttatatctcttggccatttacatgtcttgttttgaaaattgtctattcagattttttagaaaaccttgatcgtgagctccttccaggctctgactgatcacccagacctgataaactctcagcatataattttgtgggaggcgagatggaacaaaaactccctaggaagactttgtagcagtgaaaaaacctcttgaaactcgacatctgtaaattagagggatggcagctgagtagctcagaccaccttctttttgaataaacagaccagagtgaagtttgggactgtcttgcacttccttttgaacttggggaatttgatctagcctcgaactcctcctatgactatcagaagattaaatgaaatgatatatgtcccagcacagcatgtaatatatggtaaacactgaataaatggcaattgtgcctgtgatgactatttgatcttggggttgactatttgatgtgatgaccatttgatttggtgttgtagtgcagaaaataatgccccccagagatgcccacgtcctaatccctatgtggcagaccaaataatggccccaaagatgtccacatcctaattaccatgtagtagacagaatggtgtaaagatgtctatattctaattacgtggtatatagaataatgcccttcaaagatggccatgtcctaatccccatgtggtagacagaataatgaccccaaagatgcccacatcttaatccccacatggtagacgaaataatggcccccaaagatgcccacatcttaatccccacatggtagacgaaataattggcccccaaagatgtccacatcttaatccttatgtcttaggcagaataaaggcctccttagatgtctacatcataatccccagaacctgtgaatatgtgaccttatgtaacaaaggggactttgcagatatgattaaaactctgagatgacaagatgatcatgaattttctggttgattcctaaccataattgcaagggtccttacaaatggaggtagaaaaaatcagggtgatgccgtgtgagaaggactcaaccagacattcctgactttgaaggtgggggaatgggcttagagccaggaacatgactgcttgtagaagctggaaaaggcaagagaatagactttctgctggagcctccagaaggaagcagccctgctgacaccttcatttcagtccgacaagatacatttatgacttctgacctccagaatgaaaaggcaataaatgagtgttctttgaagacaccaagtttatggtaatttgttatatcaggttggtgcaatttttatttttgttacttttaatggcaaaaaacgcaattgcttttgcaccaacctaatagcagctatagaaaactaatactcataccaggaaagaataaagagttgtactattcaaaatagtaacctgcatggccccccgtgtctattcacagctgtagtgactcacctgtttttctctgccacacacctccattctaagtaattgtagtgagcaattcagcaaagtgtggcaaaataattatattcaacaatgactggcacatattaacccttcagaacattgcttacttcaatgatcttgagtgtttaatatgtgccaatccttactccaagcacttctcatacaacagttaattttatcttcataagaactttttaggtcaatgatattatcacttcaattttacagattggaaaactgacatacagggaagttaaataatgaggctccagagccagcaatgggcaaagccagaatgtgaccgtataaagcctcattccagaataggaacaataaacaccttattatactacccactctcaaaatctgaaggtggcatgtgactatgatgttgactttggtcataagtataatttaatcgatatctactatccccttcctaaaagttgtgacaacctttattcgtgccccaaagcagtggaagtgtcttcctgggctaatagttaaaaccagcatgagaggatgtggatgcagagttaaatggagcacctaagatgacttagtgagaaaagggtggacttagatacaaaccagtcttcggtttttatgttcagttttcttcccactccaatgctgctgaatctgtaagaagattcagtggaacatttttctatgcctgtcaattcattcatgcaacaaggattcctggatgctgactgcttggtgtagagcagctgattggaattccatgacaactgtatagactgttcacaccattgcaaaaaactatattatttggataaatgcttcgattgtttgaatcagcaggtgacaagagattcttacacaaatagatgtttagactacctcctagttaagggaaacttcttgcaattctcagggctgggtacattttccaaagcccagtgtgagaattctccctgagaattataaacaattcaaattgtcttatacaatttgcaataaaatttggttgttttgccagaccgaagtattactctgtgtgtgtgtgtgtgtgtgtgtgtgtgtgtgaacgttacattatctggaagttccttgttttaagagctttgtacacattatctaactcgttagcacaactctgtcgggttggtattatttttttccactttatagctaagaaaatcaaagcccagggaacttaagcaagtaaaataaagtcacctatctattaagtgcctgaataggaaaggaagctcaaaatttaataactccaaaccctatatctcaattactatatgaaaaaaagtacagaatgcgtgttgaactttgttttgtatcaaaattcagtatttagcatttcttttgctaataaagtaaaaaggtaatgtttcattttaaaatttacacagcaaatgaatgtgtgtgtaatcacttcaaatagaattgattttttttaatagagtttttttttttaattatactttaagttttagggtacatgtgcacattgtgcaggtgagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatacgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcaaactcaatgtgtcatgtagtgtttttgcttttatttacagcatttttggggcatacttcatttttcttgtcttgttattttgatgcacgattgaattaagagaaagaaggtagtaaatatctgctgaccattaatgttcttttatttacatctagtaaaatgtagtggggaaatttcaggctctgtaaaaagaaattacttgtgttttggtcttacctctcttatataattttttcattttatccacttccaacagacagcagtcaaccacatgacacaattagattatgaggtggtatattcatctcgtacaaaccctatgcctatatcaactcaatgtttcagtattgttccactggagtgatttttgagccaattatcttaaagaagttgcatgcttagaatatcttattttacactacactgtctaaataacttttctgtctgtctctctttcttttttttggtctgtgtttgtcagttgtctttttgttaaaagtgacaaaaagcaaacttaaaccagcttgagcaaaaatggaagcaaattgacttcagcttctttaggtttgtctcagacatatctagatagaagacttcaaacagtatggccaatgctgactctcttcatccctcagctctgtgtactttcctagtttgtttcattatgcacaaggagtttctcattgtaatggccacatggaggcgttgttcacatcgctgatgggaagaaaaaataaagcatcttccattttttcctctctataacatccacagaagaattccagccctaatttgatttagcacagtggttttcaaagtgtggtccctcaactagcagcatcaagatcacctgggagtgtgtttgcaatattgtgatttataatgtacccaataattctctatactttccaaagtatttgacaccatgtttaagatttagtggccattttctgtataagactttgtgtggacaatgattcatttgacagttgtgcagaagtctggctccagtggggagaatgcatcctaattaaaatgtttgataaaagatggatttatgtatggtgttaaaaaaagaaaatttggacacttcacttcagaaatggtttagctttgttcttgcacattcctgaattaatttctttgctaattaaatgagagattatggttttctatccatgtcactgtgcatcaatttttaaagctatgaacacatctgctctgttaatatacttttaaatgtggaaatgaagacaaatgggcaattttgcataaaagttgttatcttggtaggagtggacttgatgtatgtcagacagacagtctgctgccaatttttcttgcctacatggggaaaaggaaaaggcagacttttcaggccaaatctgccctgagtaactgccttagtccgttttgtgttgctataaaggaatacttgaggctgggtaattttattaaaaaacaaggttgtatttggctcatgattctgatggctggaaagttcaaggctgagcatctgcttagagatcacataggagagagaaagcaagagagagagagagagagagagagagagagagagagagagagaaagagatggggcggtaccaggtcctttttaacaaccagcacttgcaggaactaataaagaatttactcacaccctctgaggtattaatctattcaccagggatccacctccatgactccacacctcccattccaccctacttctgacattagggattacatttcaacatgtttggagaggacaaacatgcaaaccccagcagcaaccttgtcaagtgagtttgttttggtatctttccatctctttcacacctcttcagattccacaggtgcagcctcttcctcattcttcccttactgttattagattctcgacaatgtctggtcattggcagctggggaaagaatatggaacaataaaaaggagcagactttgaagttatatacatacagagtccaacctctgagtctaatagtccttgactatgtgaccttgggcaatgtacttcaactggggtttttaacgtgactgaggacagaagcaaagggggatggagttgtcttaatgtggctttaaggttctccatgtttaaaattagctgtagaaagagatagcattcagtgcctcctcagggtactcaatatgtcttctctaatcactgagcttagattgtctcacccaggtctctcccagagaacttcatggatcccacgtttgtttccctaatataaagaatcatctcccttattctgagcaatatagcagcataggaggaagatggagatatggggaaatttgactggttactggccatgtcctgagtttcaccttaacctttgggtttcattttctttatgcaaactgcgtgtccctcaaggctaatggtagcatcttcttgaaaatactactccatcagtactctgagaggccaaggcaggaggttcactggaggccaggagttcaagaccagcctgggcaacatagcaagatacaatctctacaaaaaattaaaaaactatcaggtgcagtagcatatgcctgtagtcccagctactcaggagcctgaggtgggaggattgcttgagcccaggagttcaaggctccagtgagctatgattgcaccattgcattctagcctgggcaacatagtgagacctcatctcaaaaaaacttaaaaagaaataaaaaaagaaaacactactccaagtgcaggacaaatctatttcccttgattcttcttagttcagttggaaacagccgaaatttccccaaaggattttgactttctaagggaacatcaaatgtaaatttaagttctgcaatgtgaaaacatactcactgattttttttgccttttttctcacccacttctcatacaatgtgctgttaggtgacattcagtttggctcaaggaagagcattaataatgttacctcaaggaaataaaaacttacaagaagttaacatatttaaaacatcttcatgaacagatttggatattcaccagctaaagaatcatcttaaatccttttggaaatagatggagtacagaagataaatagattctctaaaaataaatcaggtattaattttagctgaagtattattgtaaaaagggttgctctgtgatacatgtatatatattctagaacatgtttattcagaattaagtcccattaagtcctaaaaataattgtagagtggctgaaagccagattgttaaattatctcagatgcaggtttattaagaacaattcatcttcatgcttcagtatgtaggttgtaactgttaagcaaagcttcctggagctcatggaatatataaaggaatacattgactttgatgaaatgcttcctattctgttgaataaagagggaagagaaaaacctgccattggtgtgagttaatcctaccttgttatttgaactgctctccaaggcctatccacatcttccctctcgtatgcctgctgacttggccctaccattcattgccttgcttttaatttccaacagcaggctgtcttccaggttggatattattcctgaggatggcccaggaggagaagagtgcaggaaagttctctcagtggccttgggccaacctggttctccccactttctcacttgtacttttcaacaagaataactgtaagatgtgttaggaatgcaacaggaactgactagaacagcctggactctgttccagttccctgtagaaacaggacctccttgaccactttaacccagtggctcctgtaccccagggtataaaacccagggtgggctgcattcttgggtccctcacatgtagtgcaaattagggcacatgcagaagagactgcatccaccctgagcagctttcctgagccataggggaccaactgcccctaagacctaggcttctgttgtcctttgctatctgcaagtagcaaacctgatccatgtgacttaggtgtgtgggagttctgtcttcccagacttagataagttagtaaccagtgcacagtgagcctgtgcttttgggtgacttggggagggaagcactctcaacagcctcttcttattagttccttctcctcactgctcactcctgttcatgagactggctcttcatcacctgaggaactcttgccttcagagaatgacagaagaaaagctgtcttattccatttgtgctgttataatgaaataccagagactgggtaacttaggaagaatagacatttatttctcccagttctggaggctgaaactccaagatcaaggtgtcagcaggtttggtgtcaggcaaaagctgttctagtttctgagatggagccttgttgacacatcttctggggtggtgagtgctgtgtcttcatcaggtgggaagtagaagtttaaaaggggtgaactctctctgaagcctctcttagaagggaatgaacccatttatgagagcagagtcatcatgacttaattgcttctccaaagactgtacctcttcataccaccactatggggattgagtttcaacacatacacccaggctcactgcaacctctgcctctcaggttcaagtgattctcctgcctcagcctcccgaatagctgggattacagtcatgcaccaccatgcccagctgcttttttgtatttttagtagaggtttcaccatgttggccaggctactcttgaactcctgacctcaggtgatccacctgcctcggcctcccagactgttgggattacaggcgtgagccaccgcgccggcctgattctattttcaaatgataatatttggggaatattgggtgaataaaatatattcttaaaattatttttactggtaatttttactttttaaatgtggcttctagaagacattatatactgtgtgtcttgtgttacatttctatttggcagtattgcttgacagttatctctggcctctgtgtcaaatgtatacttcactccagttacagtaagcttcatatttattaagcagtcactccccattcccctctccagcccctgaccaccaccagtctgctttctgtctctgtggatttgccttttctgacaacaatatgtggtgttttgtgtctggcttgtttcacttagcatcatattttcaagatacaccctgttttataggtgaatataaggccaaatcaacatctgcttccatttttagaatcctgcatgatatttagaatgtactttcatgctgagtcatgtcttgatattacagtttttacctatttttttccttgatttttttttttttttttgagatggtcttgcactgtctcccaggctggagtgcagtggcacaatctcggctcactgcaacctccaccagccaggttcaaaagattctcctgcctcagtctcccaagtattggggattacaggtgcgcatcaccacgaccggctgatttttgtatttttagtttagatggggtttcaccttgttgcccaggctgtttctccaactcctgacctcaagtgatctgcccgcctcggcctctcaaagtgctgggattacaggcgtgagccactgctcccagctgtttgatcattttcttaagcttaatttgaacttacatttttattatgtgatcatgtatgtgtgacaatattgtaagcctttaagaaattattgtgaaaatctgcaaaataagatgttaagcaaagtgagtactctattttactactattgggagtgaaattttttacacttttcagtttattatgattttatcttctactaagccagagtttctcaactgtggcactattgagatttagagctgggtaattctttgtcatggggctgtcctgtgcattgaaaactttaatatcatccctgacctccgtctactagatttcagtagcacatcatagacttacaatctcaggtaatcaaaaatgtttccaaggggctgagaacagagggtagaattagggagatgttggtcaaaggatacaaaatttcacttaggaggaataaactcaataaatccattgtccaacatggtgactagagttaatgacaatgtactgtattcttaaaaattgctaagagagtttattttttgctcaccacagaaaatataagtatgtgagataaggcatatgttaactagccctatttatgtcgacataattaatatatacaatttttatcaattaagatgaatatattaatgaccatctaatatttacagacattacctaaagacttctggagggaaggtgggggaggggaaagaactccttgttaattattgacctaaatcatagaagtaggacatgtacacgattaaatctcattatttaaaaaaagtgcagaacgagaacaaattttcaagaattatatggaacatcaccgcaagcactaaatacaaagatatttaggctcttctttctctgattctccccccaagatttcagtttttattaaagtcattgcgtgttatattgattaatgggtacaaacacacagtgtgatagaagagtcctggtgtttggtggaccagtagggtgactatagtttagaataatccattgtacatttcaaaatatctagaagagaatgattcaaatgttcatagcataaagaaaagacaaatatttaaggggatggatatctaaagtcactgatgtgatctttacaattatataaatatattaaattatgacgtgtaccctgaaaaaatgtaaatctattatgtatcaattatatatatatatctaaatatagatatatatctaaatatagatatctaaatatagatatatccatatctatatctacatagagattttatatatataattgatacataacatagatatctatacataatataggtatctatctatatattatatctagatatattatgtgtatctatctagatatctaaaatatagaaatctatatatgtaaatatctatatatctagatatctaaaatatagaaatgtatatatgtaaatatctatatatctagatatctatctatctagctagatatctagatagatagatagatatagatatctagatatatagatgtctattgtgagatatctagaacaaaaataaatgataaatattgtaacatattaagcatgaaaatagccacagagatttgatatatgaacctctttatttattatctatatgaaaatattggggtccaaaatgctaaacaatttgctcaaccttgactctttttcaactggagatacacttttcatactagttgataaaagagtcaaggttgttctctctggtatacttcattattattgtttttcttgacaaatgcctaaaatattctatcccattcaagaggatggttggaaaaaaaatccacaataaaaaattaagacaaactatggaatcgatgcaactaaaatgcagaatgtcttttatttttatttatttatttatttatttatttatttatttatttaagagagaaacaccactctcattgacttggaaatatttactagctggaaagaatttcatctttacttcactactttaaaaaattaagtttttgcattacgcattattattattattattatttttgagatggagtctcaaaaaacacagtctcagctgtgttgcccaggctggagtgcagcggagcgatctcggctcactgcaacctctgcctcccggattcaagcgattcttctgcctcagccttcctggtagctgggattacaggcatccgccaccacacccggctaagttttgtatttttagtagagatagggtttcaccatgttggccagactggtctggaactcctgacctgaagtgaactgcccaccttggcctcccaaagtgctgggattacaggcatgagccactgcgcctggctgcattatgcatttttggtgttctttgattttcctttttatacaatgaactttgaaaaataatcaaaataaaatatgttgaatccagaacttccagtattgcaggcttaaacaacacaagaagcatctgcatcatgagaataaatatggaaaattcttggagcttccataatttattacaaaatagtcctgcatctgttttaggggagacacattttcaaatggaaatcaggattgttggatatcctgtttatctatggacattcagaaatgatactgagacagtttctttctaagaatataagatttgagaattttaatttttttcccctttaggactttaaatattgcctcttccccagggactcctaccttttatttgagatacgccttcaatttagttgcacattgtaaaaaaggcattttaactgcggctgcaaaggtaaaggtctttagtcagctgaaatgctgacttgcaaaattaaagaagataattttgctaaatcagctacaactttaatggccatttaaaaatatcatttcacttgtcccgaagaaatctttcaggttaccttgtagccgactctgatattggaataaaatactgattagtcaaggttttatctcaaataggatctgtttgcaaccacagtagtttttataggacattaccatgaagctctgtttgcaaaaccagttattttctccttccttcgttccttccttccctcttccttccttccttcccccttccttccttcccccttccttccttcccccttccttccttccttccttccttccttctttccttccttccttccttccttccttccttccttccttccctccattttttacataaagtttttttttttctatgttcagtctctatggtctcatgtcccgccatggctttcgacagcatgttcagttgatgattctcagatttacacagccagctcagacctcttctctgagatcctgccaaattcaccaccctgcctggccatgccaccaacattcttaatatgccatgttcaggataacgcttaagattttcatgtatcatcccttcctcattaggatgaataataccagtagatatatgggatatattgatttttccctatgatatgatatgcttgttttctatttcagtaatttttgttctgacatttattattttatttaaacttattaaaggattcctctactgtactttcactgatttctatacttgagtattttaattactttaaaaaattcatttataactgcatatttatatatcctttgggatatctatctatttttctatctgtctgtctatctatttatctacctataatctatctacctatgtatctatctcatctgtgtatgtatgtatgtatgtatctatctatctatctattatccatctcgtatatctatctattcatctatctaccatctatctacctgtgtcatctatgtatctatgtatacatgtatgtatgtatgtctctatcacctatctcatctatctattcatctatctatcatctatctatataatctatctatccatctgtctctatttatctatgtatatatctgtctacctgcctgcctacctgcctatctattcatctatctatctatctatctatctatctatctatctatctatttatctatctatctatctatctaatcacctgtcatctctatctatccatcatctatgtatctacctaccaatcatcatcatcatctatcacctattatctctctatctatctctacttatgtatatctaagtctactccaaaagcccattgttagctgagcgtctttgatgtacaaatatgtgataattgaactgttatttggtggagtaaattacaaaaaaactggccacaaagtcttcccatccctgtaggtgcagcccatctcagtgggattttgctgctcatccctgtaggtacactccatctcagtgggattaacggatgtattctattttttcatctcctttgaatctgggcttgtcctgtcattttctttaaccaagggattattagtcacacagcaagttgagatccctgaaggtgagatccctgggctgacgccttagggggtttttagctccctctcttgcctcctttgtacatgatactgactgggaaagagcctggtccaagctcctggagggtgaaaattatcctgttcctgtggggctgccagatgattgcaggctcttgagaaaccccggtgggtgaaccatccccctgaacccaactcaagctgcttatcactagaatgatgaacaatatatatatatatatatatatatatatatatttttttttttttttttttcttgagacagggtcctgctctgtcactcagaccagagtacagttgtgtgatcacagctcactgcagtctcaaacttctgtgctcaagcaatccttccacctcagcctcccgagtagctagaattacaggtgtgcaccaccacacccaggtattttttgtattttttgtagagaggaagtcttgctatgttgcccaggctggtctcaaactcctggttcaagcaatccttctgcattgccctcccaaagtgctggacttataggtgtaagctgccacatccagcctaaacattgttttgagtaacttaatttttaggacactgaacaaaaatatatgactgatttctttgtaaaccatgaattaatcaaaattacatattttatcattccaaatatatattttaatctgctttttaaaaagttatatttttgtcgctgatgtctcaattgccctgtgatcagagagaaactatatatgctattgattctttgaaataaattgaaatttcctctgtgatctggaatatggctgaattttatcaatacattcaaggagactagtctctgttgggtgttctaaaactacactcactcattttttttttttttttttggctttgttagacatttacaaacccaatgtagcttttctggttttcttctctgtgaacagcctgctcaaatattttgtccattttctacaggattgctttttggttcatggaagttgttcatggggtctgagtgttgatcctttattaattatacatgttgaataaaactacttcccagttagggattttgcactctcttcatggttagttctaaaagcacatatgaaagtgctctgcatattatcccaattgttcattacttaatgctttctgagtattctagtaaaacatcttccttcctttctttctttctctttgttttctttttctttctttctttcttttttctttctttctttctttttctttctttctttttctttctttctctatttctttctttctctctttctttctttcttctttctttctttctttctttctttctttctttctttctttctttcttcctctctctctctctcccttccttccttccttccttccttccttccttccttccttccttcctttctttctttctttctttctttctttctttctttctttctttctttctttctttctttctttctttctttctttctttctttctttctttcctttctctgttgcccaggctggagtgtagtggtgcaatcatagctctctgcagcctccacctcctgggctcaagtgatcctcctgcctcagtctcccaagtagctggtactacaggcccatgccagcatgcccagctaatttttgtattattttggagagatggctttttgctgtgttgcccaggctggtcttgaactcctaggctcaagcaatccttctgcctcagcctcccaaagtgctgggattacaggtgtgaggcaccacaatcagccataaaacatattcttaagcattaaagattgaatcagtttctagttttcttgtcttttggtattttggtgcaaggaaacttaaagtttattcattgcttttattctcaagtgaatacaaaaccctctactttttcagtacttagaagataaacaacacaaaattaattatttcaggaactatatcaatctaaactcaattattttttcagttgaaaatacggcttttaattgtctgaagatgaggtgaagatgaattaacatgggataaaacagacttattctgtacatgagaatatagtttgtttatctgtgcacccacctaccttaagggaaatacacactttatcagatggttttttagtatcactgttttaaatgcaatacgcatttatcatgaaagctagtgactcttgttgactgtgcgtccgtcgtagtcaggggctttacatatttaaataataaccatgagtcttcaaaaagagctcatttacaactagagaaatgataaaacagtgatagaaggaggtgttgaggaaattaaattagaacacaaaataattaaaatggtgaattaactatatacatgagtagatttcttatgaacccttatcagagcttagaaaactaaatatgcttaggccagcacttgtcaaactttaaagtgcgcccactgtcttggaggatcttgttgaaatatagactcagattcagtagatcttgaggggagcttgagttttctgcaattctcacctgctcccaggtgattccactttgtgtagcaaggcactaaactagcatcttggtggggggtggggggggtcttatttttgtcagtttcttacataaaaattttcaaagtattatgtttattaaaatctttttttgagatgggagaagaaagtacatttaaatgacttggctgtggtcacagtatatcttcaagttacatctttgcaggcatttggagttgaaataaatttcgccgtaggtttcttttttcttttcttttctttctttttttttgcagaatttttttttgttggctttgttttcttttgaggtaaatcttatgtaacatataactaaccattttagagatgcatttgttggcatttagtacatttgcaatgttgtgtaaccatcaccttcacctagttccaaaacatctccatcaacccaaaaagaaaacccttaccagttaaggaatcacttcctaacgctccctcacctcccaaaccctggcaatcactgagttgcttattgtctctatggatttgcctattctggacatttcacataggtagaatcatgcaatatgtgctcttgtatgactggcttgtttcacttagtataatgatttcaaggtccattcgtgttgtattctgtagcagaatttcgtttctccctggtcagtcatggtggctcacacctgtaatcccagcattttggaaggccgaggtggaaagatcagttgagcccaggagtttgagactggcctgggcaagacggcaagatctcatttctactaaaattaaaaaagataattagccaggtgtggtggtgcacatctgtggtcccagctacttgggagactgaggtgggaggatcacttgagccctggagctgcagtgagctatgatggcatcagtgcactccagcctgggtgacagagtaagaccctgtcagaaaaaaaaaaggaaaaaaaaaaaaagaatttcattctttcctattggtgcaaattttctgttatacggatagaccacttattgtatacccattcatccattgatagttaatggatatttgggtggttttcattttttttctattgtgaaagatgctgctataaacatgcatcacagtcatttgcttgatgtggctgtagaccaatccgtttcttttaaaatgaaacccaatgtggcacccttatattagaggagagatattcaaggcttgcatgataaaatcaacacagggtaggcaccttccttccttatgtttagtatctcccattccatgcagacactacacacagatagacacaaagacaccctggtaaacaaccctacaagattgactctggttccataaaccaccctccttacttttgcagagaactagtgaacttccaaaattttcccaacatgttatttggtgcattttgctgggaaggatggaaacctccattttccaacttgctgttctgtgatctcttgggcagtatttaagtcgttaagaaatagagtaaatatcaacatgcctttttatattttgtgtacaaggattcccataaactgagttggaaggatttggaagtcacttttttctctatttcttgaaaaatctggcatttaaaaattacaactgtttagttcccttatattttgttcctccatcccttaactttctattcactttaaagcattccaatggctgtgagtgtcacccaacatgatataaaataggcagagctcttctattttacatagcacagaggaagaggtcaacattgaaagaggctccttgagggttttcttgaggaagaatccagggaacaggttagggtctagcagaggtgccccatttttatgacaacagctctcgggggtaggggggagcatttctgcacccactactcatccccttgtagctctgtgctttgctgtgatgtttgatgtctactaattgaaagtccaatttctttggctccatttctactatttcctggatttccacttaactctccctacagaagagtgccggcatttgtatttttaaaacaatttccaggggattctcatgaacaaacctatttggagtcaattgcctctgaaggcataacctcacaaagtggctaagtctactctttaatgttcttttgcctactgcattgctatgaagtataaatcacattattgaataaattttatttgtcatggattaaacactgtcaaccccccaaaattcacatccacctagaacttgtgaaagggacctaatttagaatgagggtctaatgtaagggttgagatgagattgtcctgcattagggtagaccctaaatgcaatggcaagtgttctcgtaagagatgcacagtgcagagacatgcagagaaaagaggagaaaaccacatggagatagaggcagagactgcagtgatgtagccacaagccaaggaatgcctggagccaccaagagctggaagagccaggaaggatcctcctctagagatatcagaggaagcatggctctgtggataccttgattttagacttccagtctctagcactataaaagaacacatttctttttttggtaatagttatggcaggtgaatgaaactaatatgccatgtaatgtgccaatccacatatgaccccttaccaaacacatgagcagcctcctccactatcaacatcatccaccaaaatggtctattttttacaatccatgaacctacattaacacatcattgcctgaagtctagagctcacattagggctcagtctttgtgttgtacattttacgggtttggacaaatgtgtaatgtcatggactcatcattatagcatcatacagtgtggttttactgccccaaaaagcctctgtgatacatttatttaatagtccacttctgcccctagagcctggtaaccatgatctatttgctatctccacattttgccttttctaaaatgtccaatagttgaagtcgcatagtatgtagccttttcagattggtttctttcacttagaaacgtgcatttaagtttcttcaatgtcttttcatggcttgatggttcatttcttttcattgcctagatataggaatgtttacttatctgctcacctatggaagactttgattactttcaaattttggcaattgtaaataaacctagtatacatatttgcatgtaggtttttgttgggatataagttgtcaacttctttggttaactaccaagcagtgtgattgtttaactgtatggtaaaaatgtgtttagttttgtaagaaaccaccaactgtcttccaaagtggctgtaccattttgcatttccatcttctaggagtgagagttcctgttgcttcacattctcaccagcatgtggtgttgtcagtgctctgaattttggcccttttttctataggtgtatagcggtatctcactgttttgatttctaatttcctaatgacatataatgtggaatatctcttcatatgcttgtttgccatctatacatcttctttggtgctgtatcttaaagtttttgacccacttaaaattgcttatcttcttactgttgagtcctgagttttttgcatatttcgaataacagtcttttatctgctatgccttttggaaatattttctccctgtctgtggcttgtcttctcattctcttgacagtgtcttttgcagagtataaaatttttaattttcatgaagtccagcttgccaattcttcctttgctggataatgctttggtgatgcaactaaaaatcattaccaaattaaaaaggcatctagattttcccctgtgttattttcgaggtgttttatagttttgcatctggcattaaggtctgcaactcattctgagttcacttttgtgaaggatgtaaagtctatgtcaaggttcttttttttaagatgtaaatgttcagttgttccagcatcatttgtggaaaaggcttttaaaaaaatatatttgtcacattccaattcaatcagttttaaaaaattgttttaatttaaaattcagaataatgtttaaagctttatgttggacaaaaggcatagttatttgtattagtttcctgggggtagtcttaactagttgtcacaagacaggtggcttaaacaacataaatttatcctcttatcattgtagagaacagaagtccaagatggagctgttggcagggccacactctctcagaaaatcaaggtgtcacgctcgcttggacagctctaggggaggatcattcctgcctctcccagctcctggaggctccaggcatccctgggcttgtgactacatcactccagtttctgcctccatctccacgtggccttctcctctgtatctgtgtctcctcttctgtctcttagaaggatgcctgtcactgcatttagggcccaccctaatccaagatgatctcatcttcagattcttaactaatgacatctgcgaagatcctattttcaaataaggttccattcacggtttctgggggataggacatagacacatatttagggggtcaccattcaacccattataattgtacccagttctttctggaggctctaggggaggatcctccctgcctctcccagctcctggtggctctaggtgtcccttggcttgtggccacatcattccactctctgacaccatctctccagtgaattttcccacttttctctctatatctcttgtaagaacacttgtcatcagatttggggcctgctgcccctaatccagcataatctcatcttgattctcaccttaaaattacatttgcaaagattatttttccaaattcacaagttctagaggttaggacttagagctgtctttttcagagacacaagtcaatgcattatattaatatttagtgagttatctagattcactaagagtggagttttgaagaaattgagcaatgttatgaattgtaaagccaggatggaggcgagttctgtttccacatattggaatgagagatacgttactgactgtgaaagctatatactctgtgaaatactactattgcactacttggtgtagaaataccaacaccatcctttatattttccctgatagggtataacttaatatattagctaacgtcattgtcaaatagttggtcttggcttttttaaaaaaagagagacatagaagtgctttactctgttctcacgctgctaataaagacatacccaagactgagaaacttataaaggaaggaggtttaatggactcacagttccacatggctggggaggtcccacagtcatggcagaaggcaaaggggaagcaaaagcatgtcttacgtggcagcaggcaagagagtgtgtgcagggagactgtcctttaaaaaaccatcagatctcctgagacttattcactatcatgaaaacagcataggaaaacctgtccccccccgccccatgattaaattacctcccaccaggctcctctcatgacatgtggggattatgggagctataattcaaggtgatatttgggttgggacggagacaaaccatatcatatgtaaacataaaaggctgccaaaatgttttgtcttcctcttccatccaatgtgattaattctccaaactatagctggagtcctcttcctgaaacacaccagtccatttgtcttccttctgttcccagcccttgtatggcagctctgtatggtgatcagaacaacgtgcattccttttggattttgcctcaaagagaagactctgtctactggtctggttgctttttggttttgtttgtgtttgtttttgctattcctgcttgctacagggacaccaagcttacctcttggtccatgaccatgtggctctctctgcccagaaaatgtctcccttcttctagaatgtgcgtttaaaggtttcaccaagctccctcttggctgttccctttagtttcagcataggcaccatttcctttggggacctttgattctccaaggcccagtgaggtgtgtcttctgtgtgctgctgttgcacttcaaaggcaactctctttttcaatttttaatgtgaaataagcacatcacggagaacggggtgtatccatcccctcaagcatttatcctttgagttacaaataatccaattactttctttaagttcttttattataaaatgtacagttgagttatgactgacttaggtcaccctgttgtgctatcaaaaagtaggtcttattcattctttttgtctgttttgtacccattaaacatccccacctcctctaccaactcccaactatccttcccagcctctggtaaccatctaggcaaccctttttaatatcataatgtcttcagttctgattaatcttctgtcttttctgatgcatggcaactctcccaaatagtgtgtatggcctgaataattatggtgtaatttggagaagattagagtatcacattttctttgaattagtaagaaatattttggaattacttgaaatcttgagcaaacgtgatcacacttacactggattttttccttaccccaaagtatcttaatatcagtaactcagtacaaaggcatcattgtataagttattttgatgaatggctgttattttccaggttggattctggggtattgtactggactgtgagaaagactctttccttgaaaggtatcagcgagacagcattgtgtctgtctgatatcacagactccgaactggagtcccatcggatgaaagtaaaagtcacttaactgattatgctcttcagcgaataaaagcttccatctgctcctttcagattcactgttcaggattctcactagaaaacggccgttggaaagatgatcttagagaaatattaaatagagcattcttcagcctcgaagggccccttgctccctgaggtctgaatggcatttggatgaaacagcccactgcaaatagacaaagggagaaagcggaaggaaacattaacacttcccttccgggtttcggtgggagagaattatagcatgttttcctttctcaggttcttacagaatgcaattttactatgcctcaaattcatcagagaatgaatgaatgggatcaagagagaataaactgaccaaaatgatttgtgattagacagaggtgatggttgtacaacattgtgagtgtactaaggccactgaaatgcacacttcaaaaatggttcattttttatgagacttttactttaatcaaaacagagaagcatttagcttttgatcctcagaaaataaaaaaatagaagaagtcttctcttaggtaacaaaagtgagcattttgagagaaatagtttcaatgagagtgattattaagcacaactggaaatgtttggaattcttttgaagtgaacaaagaagagacagctcattcggacgtttccttttatcctgcgcctcttacttaaaagcatttacaaagtttgaaccatcatagtctgtggaagaatcagatgactacacagcttgcatttcttttgaagtatcttttaatgactataaaatacacacatcttcacacctttcttagaggtcaaaccagaaatgctgacttgaggtctttgcaattcagagctccttaaaagcattccaaaaggacaaattcaatcttttagaagcagctacagtggactttaccttcctccctcttgcatctcagtgagtaagaagattaggaataatggatccagtttatttgcctggttctaagttcttcatagcatgttggtcaagccattctaacacatgtattcatgttctagtgcaagtataagaggaatgggatccctggctgtcattctgctgatcctcatcctgaaatgttactgtcttgttgttcatgcagacaatccattccttactggtattggtctcgccattccttgttctacttcatgtcaatgaccttcattttcaatccaccattaccaccctctaccatggccggatgtgccattttctgaaactgtcatccatctaaaaccttacactgaaaacttccactctgactccaacttagatcttcaacttcctaaactctcaattcctaccaaaatgggacctccagtctctcagctcctccattgttccccagttatcagcctttctgccatctcacaccgatgcccatagagcctgaacagcatgggtgattactgcatcttcattcctgattttcaatgccttatctgtctttatttttttttatcacagtgattcacaaaatgccttattctagatcaggttgtttgtcttttcactgcttttgtcctagttttggaagagtgtgtgagaaatttggcaattaagtggttcattgccaggataaagtcgggttcttcactgtctaccctgctttcctttgttgcctggtacgtttctttgtagcctgtgttactttctaggactgttgtaacaaattactgcatacttgatgatttaaaataactgaaatttattctttcaaagttctggagaccagaagtacaacatcaaagtgtcagcagggtctcacttccctcagaggccctaggggaggatccttcctgcctcttccagctcctgtaggctctaggcatccctgggcttgcggctgcatcactccagtctgcctccatctccacgtggccttttcctctgtgtctgtatctccttttctgtgtcttggaaggacaatgatcattacattcagggctctccctaattcaagatgatgtcatcttcagatccttaactaattaaatatgcaaagaccctatttgcaaagatggtccaattcacaggttccagggcttaggctgtggacgtacctttttgcccttgaatatcggactcaagttcttcagctttggaatcagactggcttcctagttgaatacactacaattgtatccagttccttctggaggctctaggcggaggatccttcctgcctctcccagctcccgggggctccaggcatccctgggcttgtggctgcatcactccagtctctgcctccgtctcctcctggccttctcctctgtgtctgtatctcctcttttgcctcttacaaggacacttgttgttgcatttagcaggactcaaattaaatgcacaatggtctcattttgagatacttaactatatcacatgtgcaaagactatatttccaaataagcttctgttcacaggttccaggggtacatatcttttggggtggagcatgacaatacagagagcttacttaactcttgctcccatttctagcagagacaattgaaaacttttagtatttcctgaaaaaaatctcttctgtgtcacagggaaaacagatgccaccatacaggaataccttccacttccaatactgttttgtatttcaattggtctctgcatcttgcctggtgttactttctgtctatttaggaacaatcacactcccctgtgcacatctccaaccatcttccaacaccttttgttctgatatccccaggaagctcacttcatatattatgttccctctagtgtatccagtgaatcttcaacctctccatgcatgaggtccaatatctttcccccatacataacctgatattggggatgtgatggttaatactgtgtgtcaacttgattggattgaaggatgcaaagtattgttcctgggtgtgtctgtgagggtgttgccaagagagattaacatttgagtcagtgggctggggaaggcaaacccacccttaatctgggtgaacaccatctaatcagctgccagcacggccggaatataaaacaggcagaaaaacataaaagactatactggcttagcctcccagcctacatgtttctcctgtgctggatgcttcctgcccttgaatatcggactccaagttcttcagctttgggactcagactggcttcattgctcctcagcttgcagatggcctactgtgggaccttgtgatcatgtgagttaatactccttaataaactctctctctctctctctatatatatatatatatgtatgtgtacaaatatgcatgtgtatatatatgtatgtgtatatatatatatatgtatgtatatatatctcctattagttctgtccctgtagagaaccctgactaatagaggggtgaataagaaattcgaggaatggagtaagggacagtaatagggtcaagaaaatgtaatctaaatgatagagaggaaaaggatatatgttgtgttcacttgcttgggccaccataacaaaggaccacagcctgggtggcttaaacaataggaattttttcttctgtggccttggaggcttgaagtctgagatcaaggtgtgttgttgatgccatcatttttgtgtcctcacctggtcatccctctgtgcatgtctgtgtcttcatttcctcttcttatgaggtgttttagtccatttcaggctgctataacagaataccatagactgagaggcttataaacaacacacatttattctctcacagtcctggaggctggaagactaagatcaaggtgtgagcagggctggtttctcctgaggcctctctttggtttgtagatgctgtcctctccctgtgtcctcacatggtcatgcctctgtgtgtgtctgtggcctcatctcctcttcttcttctttttttttttttttgagatggaatctccctcttgttgccgaggctggagtgcaatggcgtgatctcggctcactgcaacctccgcctcctgggttcaagcgattctcctgcctcagcctccgaagtagctgggattacaggcatgtgccaccacccccagctaattttgtatttttagtagagacggggtttctccattttggtcaggctggtctcgaactcctgacctcaggtgatccaccctcctcagcttcccaaagtgctgggattacaggcggaagccactgcgcccagcccttgtctcctcttttttatttattatttatttatttatttatttttttgagacagagcctcgctctgtcacccaggctggagtgcagtggcacgatctcggttcactgcaagctcgcctcccaggctcactctattctcctgcctcagcttcccgagtagctgggactacaggtgccctccaccatgcctggctaattttttgtatttttagtagagacggggttacactgtgttaaccaggatggtctcgatctcctgaccttgtgatccacccgtctcggcctcccaaagtgttgggattacaggcatgagactccatgctcggcccctcatctcctcttcttaaaaggaccacagtcctattagattagggcccactctaggtacctcattttaccttaatgacctgtttaaagaccccatctccaaatacagtcccatactgaggtcctggggcttagggctttgacatctgcatattgggggccacagctcagcccataacctatggtgaaaatcatagtagccagtactatagtggaatcacctgtaaaaaaatcaggggtggaattcgttgcttgttaagcttcacgttgaaagatctgtttgattctttttacaaaacgaggaaagatcagaggaaaacaagatagcaagaacatttgccctactacagtgagatttggattccaacagccgagttgcctctgaggttgtctacttcatcacttttccaaggacagctctcatttccctgttcatgactcttatcgtgtttagcagctttcaagcgaccttcaggataaagtccagactccattaagtgaccctccaggagcttcatgcacaaatcatagttacctatttatttcctagaacacggcaggttctttgaatttccaggatttgatcatgcttaattttctgtgttaacacaggggaggtgcacattaatttcttaaccgacgatggatggatgaaagaatgaatgaagcttagcattctggaatctctggctccctggagagtctgatgaaagacatagaccctcttccaaggaaaagtcacttaagcatatattaccaagcattgcaaattatttcaaggaatttatggatctcccaactttcaaacattaatttcttagagagagccagcggacaccagaatagcaaaacagaactttattagttcattctttcttctcttttctccttttatttatttttaaatcatgcagccctttaacaggtagtttcatgctttatgtcactgttccagaaatgactcaatgtgaattgcattttgcaatgacccagtcaaaataatgattagcagtaaaggggaaaagtcttggaatgagttaatgaggccaagaggataacttattctgttcagaaaaaaaatgtaattgggatatatagagacttgtttctttttctgcttcttgcaaggaagggaatattctgaaagttagagtgagtaataaagcaaaaatggatacgcaaaccagatgtagattagaaagctttgtgttgccattctttgattttccctaaattgctacatgagtgtggcatgtcagaattttcatctccatctttgcacatccacaaattggatgtgcaaaaacctttccttacctctgcctgggatttttgtaatgtgcaaatgcagataataaaagtgatacagagactgcaaagtgctgtccatgggaaatagttattgagattaatattattattatgctattgattaattgtgattaggcaggtggacatagttcaattagaaatcaaataatgaaagcaagaagttttgggcccaaagtgatctcaaatcccagtgtcttaaaattgaaagcattctgtaggaggttgaaagattcaacatgtgtcctactcaggttggtggtaaaacaattcagcaattgcattatatttactcagatacgatgcacaggtgattatattattatattactcaaatgacttcagatgactatatgattatatgattaaacatgcatatagaaggtctcattcattcattttaaaagttatatttcatgagtttgcaaaaatgtagaataaaattaaagccacccagaagcctagaatgcagaaataaatttgcctaaccccccttttttttggttaatattattatattcttcatctatgcctgtggttcttttttaaattcttttttaaacttttattttaggttcaggggtacatgtgcaggtttgttatgtaggtaaactcatgtcacaggggtttgttgtatagagtatttcattacctaggtactaaacctagtacccattagttatttttcctgatcttctgtctcttcccacccaccacctttcaataggccccagtgtctcttgttctcctctatgtgtccatgtgttctcatcatttagctcctacttataagtgagaacatgcaatatttggttttctgttcctgcgttagtttgctaagcataacggcctccagctccatctatgcccctgcaagggacatgatctcattctcttttatggctgtatagtattccatggtgtatatgtgccacattttctttatccagtctaccattaatggggatttaggttgattccatgtgtttactattgtgaatagtgctgtgctgaacataatgcatgcatgtgtctttatgacagaatgtcttaactgagaatagttcttcctgcaggggacacttggcaatgtctggaaacattaattgtcacaagaaagggtggtgaggagtattggcttcttgtgggtggaggccagggatgtttctcatcatcctatagtgcacagaattgattccatatctttacaatggtgaactgtggtggccctcataacaaaggattttgcattcccagttgttaatagtgtcatggttgaaaaactatggtctatgtacaggcattttaatgttaagtatctactccatgatgacggggtgtggctgttttcataaataacccttttctaatctaacccgaagtgtgtcttgagtggaatggcattctcttacctttgtcttttacctgcaggctatgtctaaaagtctatacgtggatatataatatctacccactaatataagtgcaagagctgccttatgcctgatggtcagcaggatgttgtatgaatcaagttttaaatgctgggtccatgaatcaaactgcttcctagtgtcggataagcctatatgttctgagggaaaatcaagggagggattttccttttaaagttcatttaggggagtctcaaatcccattgccatgtttgctttggtcactagaatttacgactatgtcatgtagacaatgagtgaatatgtgctgttctgataagttgcttattgtaatctttgaggttcttatttatctatttcactgttttgtcccttctgagaaacacaataaaagcaatacagagactgcaaaatgctgtccatggggaatacttattgagattattgttagtgttattatgctattgattaatcatgattaggtagccatactttttcagtgggattatgcaggttttttcttgctgatttgtttgagaacctaataatcccattaaaaatgagcaaatgacaggactagacatttctcaaaagaggatattcaaatagccaaaaaaatatgaaaaatgctcaacatcacatatcatcatggaaatgcaaattaagagcataataagatgccaacttaccccagtcagaatggtcattattgaaaagtcaaaaaacaatagatgttggcacagatgtcatgggaacacaaatacactgttggtgggaatgtgaattagaaaacccctaaaaaaacaaaaggagatttcccaaataactgaaagtagatctactatttgaccctgcaatcccactactgggtttcaacccaaaggaaaagtaatcattataattaaaaagtcacctgcagtcgtatttttatcacagcataattcactattgtaaagatatggaatcaatctaagtgcccatcaaagagatgagtggataaagaaaatgtggtacatatacaccatggaatattactcagctataaaaaagaagaaaatcatatcttttgcagcaacttggatagaactggaggccattatcctaaatgaagtaactcagaaaagaaaaccaaacactgtacgttatcacttaaaagtgggagctaagctatgggtaggcaaagggattcagagtggtaaaatggacattgaagactctgaagtggggaagatgggggggatgagaagtaaaatatcacctgttgggtacaatttacactatttgggtgaaaagtgtactaaaagcccagacttcaccaccatataattcatttatacaccccaaaccacttgtacccataaagctactgaaataaatttagaaaaatagtcgtattaaataaactgtattatatcttctcttaagaactcccagaagcagtaagtattatgtagctagatatcttgatttaaaattatagccaaatagaaacataattagatttccaatcagcaagttaccatgtaatactttctgatattagatataacaaaagttcactatgtaataaatttttactgtgtatcatctaagtataagatgccaaggactttttttgggtgggagtacatgacgaattatgtccgtaattcataaacctagcgttttgctattctctgaatgacagtagggttgctgatgggtactagtgcacacatagtatttgggaagtttgacattttctgcgtttgggctatgatctaccaacttccatggatattgatctgagagtgatataaacttgagatcttaggatgcatgcctttcttgactttcgctgagctgtgctttctaaggcagataattcatgtccactctggtcaatgcatgaatgttgtgtttctccccatgctagatttcaggtgaaatacttttcaaacgtttaaactgtacttaagcataaacacccttagcatttaagctaaaccttattataaagtaatgaaatattgcaacagatgctaaaaggtaggattttttttttttttttgacagagtctcactctgttgcccaggctggagtgcagtggcgcgatcttggctcactgcaagctccgccttcctggttcacgccattctcctgcctcagcctcccgagtagctgggactacaggtgcccgcaaccacacttggctaattttttttttttgtatttttagtagagatggggtttcacc[137 bp omitted]atttaaatcacaatgacccaatcttctcatcttttacctctataaatcactgcagggaactgcagaaggctacataggaaatctcattctctgcctgaaatctagtaaatgtttatcataaatagacattaggtggtaaaatatatttaatataacaaaggtaaaaattgggatgttagcattgtctttctggagactttggtgggctggagtctttgcttagtgatggctgttgaggttgcttcattaggggtaggttaatttggtaatgagcattcaaagaccccaaaaagacaccctactcccctgtcagagcatgcaggaaccaagaggactgcaaacttaatgacatgggcatgacctggcagagattcgaatccggttggggagggtgacgcagatgtgaaaacttgtatacaaccgggattggtcagaacaggtttctcaatgtcagcactactgacatttggggctggatgaggctttgtgaaggtgggggccatcctgtgcactgtaggatgttgagcaacatcctctggttccacccaccagaggccaataacattcccttctccaactggtgacaccaaaactgtctccacaccttgccaaatatcctccccttatttggggatcactgagctagaattaagccaagctgttattggagtccagggagttgctatgtagataacacagagtcatattggagctgaaagcaacagaaaaaaaagttaattaataataccaatgctgcttttcttcaaaattctggtcctgtttctatcctggaattttatattattattatttgcatccatgtttatttctttaaatgttgcattaaatattatttatcttggatacaaagtttcttggtgatcccttaaattttcggcctgaggccagtgcttctgcctcctccctagttgctaccctcataagctccttggagagcatgacagtctacagaaaggggtattccagatattttggtgctgtttctctatttctcttgccctattatttgctctttttgctgactgatactagagctctgcacactctcatttttttattgggtttgcttctgctgttacacaatggcaaagttgctgtggtttctgggacagaaactttattttgcagaagtgtacaaagttaggaagaaatgccatggcaaggagaagtgtgtcaggtcaagagagtgaagtggcagctttcttttgtttgtttgtttttgttttttcttttatttaatgttttacaatcctttacatttctatgtgtggtaaaacaaacaaacatagaacataaaatttacctctcaatcattcttaggcactgagttcagtggaattaagtacattcatattattgtgcaaccatcaccattattcatctccagaaatttttgtcttcccaaactgaaactctgtcctcattaagcaacaactccccattctcccctccaatgccctgtaagcaccattctactttctgtctctatacatttggtgactctaagtgcctcatgtaagtggaataataaactatggtccttttgtgactggttaatttcactgagcataatgttctcaaggttcatccacgtagtagcatgtgtcaaaatttccttcctttttaaggctgaataacattctattgtatagataaaccacattcagtttacctattcgtctgccagtggacacttggattgcttctaccttttggttattgtgattaatactgcaatatactttgggtgtgaaaatatctctttaagactctgctttcaattcccttgggtatatgcccagaagtaggattacaggatcatatgctaattctctaattctctttgtaatttcttaaaggatcactatactgatttctgtggtgactgctccacgtaattccctcagaacaattaacatggactgcaatttccccacaagaaattaaaaattaaaaaaaaaatttaaatggacacatagtcatgatacatatttatggagtgcatagtgatattgcaatgcatatattgtagagtaatcatatcagggtaattagcacatccatcatctcaaacattgatcattgctttgtgttgtgaacattcaatatcctctcttctagttatttgaaactatataaatatattattgttaactgtaatcatcctacagagccacagaacactagagcttattcctcctatctggctgtaattttgtatcctttaacaaatttctccttgtccctgccttccccttccccttccccttctcagcctctagtattctgagatccactttattggcttccacctatgagtgagaacacacaatgtttaactttttatttctgacttatttcacctaacacaatgtcctcaagttctgtctatgttgttgcaaatgacaaaatttcattccttttatggctaaatagtattccgttgtgtatatgtaccacactttctttattcatccatctgttgttggatacccagcttgattccatatcttgactattgtgaaaaggtctattctacacttttatttactcctaacaagacacaaatagtcagaatagtgaccgtatagtcacagtgtaaccaaacagtgtagcctcaaagtgcactttaaaactttttttcctttccccccagtctcaagatgtaactttaaaatgttctgccaaaacctttttgccctccttagtttttgtttgtttgtgttttgagacagagtctcgctctgtcacccaggctggagtgaagtggcacaatctcagctcactgcaatctctgccttcctggttcaagcggttctcctgcctcagcctccagagtagcttggatgacaggcacacaccaccacgcccaggtactttttgtattttagttgagatggggtttcaccatgttggtcaggctggtctcaaactcctggcctcaagtgatccgcccacctcggcctcccaaagtgctaggattacaggcaggagccactgcacccggcccctccttagtcttaaaatatatcatagaaatgaactttctttggaatacaacatccctctctttctcaccattcactcccttacaccatgcatatttatttaactatactcttgtatgtaattatgtgctcattggaaggtccaggggctaatcttgagatcaatcagatatggagacccagctgcgaaatcctagagattacctcactggggttagtctacaccctggcaattgttgagatgacaccagcctgagctccaggtggaccatcgcttgagatgaccttcggaacaacacatgcagacctcctatctggcacccctcccgcatgcttcccattccaagatccccttttaaagtccccttgtccagttgaaactttgaggtggtttctttaggtgtgaacctggccacttccccactgtcagcactttccccccactgcatctcattcttcttcttcgctttgcaagtggcaaacagccaagccgagcctgtgctcagtgacaacactaggttccaaattttacgacaggccgtaagtaccagatatctggtgctcactgattgtctcattgtaatcttgtcttaaaaataattcctttcctatgcaaatcaaaaccacagtgagatatcatctcacaccagttggagtgactattcttaaaaagtcaaaaataacagatgctagtgaggatgcggagaaaagggaacacttacacactgctggtgggaatgtaagttagttcagccactggggaaagcagtctggagatttctcaaagaatttacaacagagctaccattcaacccagcaacctcattactgggtatatatccaaaggaaaataaatcattctaccccaaaacacactgcacttgtatgttcattgccatgctattcataatagcaaatacagggaatcaacccaagtgcccatccatagactggataaagaaaatgtggtgcacatacaccatgaaatactatgcagccataaaaaagaatgaaatattgtcctttgcagcaacatgaatggagctggtggctgtcatcctaagtgaattaatacgggaaaagaaaagcaaataccacatgttctcacttgtaagtgggagacaaacattgagtacacatgaacataaacgtaggagcaacggacactgttctcaatagacaatagacaccggcagggagacaggtgggagggagtgtgtcatggcttgaaaaactacctcttgagtactatgctcactacctgggtacaatgtacccacatagcaaacctgtgcatgtatcccctgtatgtaaaattaaacttgagaaaaaaatggattgcttccctttaaattcataccgagggaattttcttttgtaaatctgaaatgttttgtaaaatgcccacaaagacttttttaatggaaatgtagaataaccatgaaacaagactaataaaccagtctttgaaaagaatgtcaattagtcataaggtacaggaagttgtggagaaaaaaaaagaataaaagaaaacctaaatttcccttcaggaaacatttatgcctgagcctaaactccaagaccaactgaaagaagaagcagttgtaccgcactctttactttccccctaacctttgtactcaggaatctgtgttttccagaaactcaacaattcccttgacttggtgactcctgcctcagctgtctgcaatatctattttatgatcattcaggaatgataaataccagaaagtgactgctcgttaaatgggtgtgtgtgcttctgcatgtatttctgggaatctgtgtgttgtgtgcatgtgtgtgtttgtgagtacctgtatgtttctgtgtatatgtatgcttgtgtgtgtgtgtgcatgtgcttctgtgtgtacacttgagtttgtgtacatatgtctgactgtgtgtctttgtgtttatgtgtgtggtgtgtgtgtttctgtggatatgtgtgctgtgtttgtgtgtgtgtgagagagagagagaaaaaagagaaaaaaagagcaaaagagacagagagaacatcattgtgggtgtttgtgctaggataaacatggaaaagtgggggaattgctcagacagtgcttaatttatctgttactagctttccttcaattaagcccttcttcctgatatgtgtggaggtttcaactccctactcgtacaaattagtattcatcactggcacttcagaaaataacatccaaaataagatcatgcctagacatatcctgaaaaaatgaaagcaataccctataaacatccaggtagaaaacaaagcaaaccaatcccaacaaaccaaagcataaactttaggaaacaaagctcctctcaggtatccctgcaacattaaaacaccaaatgagggtgccacagcacctacaggcttttaacagtagaaaaccattcgacccccaagacattcacaagcttgaaatctgttagctcaaaaagcatattcaatgtatattttgaaaaaaaaaggtaactgaaaagtcaagtgctttgctcatgagataaaacagataaaaaagcatcaatgtgtgtttttaaaatggattggcagctttcttcctagtcacgttggtttccattcccaagacagttggtgatttctgccatccatataaatgtgttctgcaccttctcctgggttatttctcttctgactgttctcctttctgagaaccagaggatgtatggttttttttttaatgctacattcatgaggaatctctttccaatttgtggacgagtgtcggtgctaccatttacgaacaagggctaagatatttttatggtggagagactaacaagccattgcttctttattaaatacagaactacaaggagtaacataaaatatagttcatagatagatgggtagatagatagatagctagctagatagataagatggatggatgcatgagtggatggatggatgaatggatggatggatgatgaatggatgcatggaggggtggatggagagatagatacataaatggatagataatctatacagttatgagccacataatgatatttcagtcaacgacagattacatagacataggcgatcttctaagattataataccatatttttactctgctttttctatgtttagatgtttagatacacagatacttacaattgcattaaattgtctgaagtattcagtacagtaaaccgttattcaggtgtgtagtgaaagagcagtaggccatacatctagcctaggtgtgtagcaggttctcccatcttggtttgtgtaagtccactcgatgatgttcacacaatgatgaaattgcctaatgatgcatttctcaaaatttatccttgttattaagcaacaggacggtatatataactcatgtatatagtttatatatgtgcatacacatgtacatacataatgcatacatatattacatatatacatacaaaaaatatacaaatatacatgtaccaggcatgggataaatacggaagaaaaatactgccatcataaagcaattttttatttcccatactccttttgttgtgttttttaaagacttttgatgaaaattaatgaaggttgaagagcatttaataagaccatacattttctattaaaataactttttgcatgcttccttaattagagagaaaatgatgagaattgacatagctgttggaaatattaaatgcaatgtgtataattttctttcatctgagagtcgagactttatttaaaaattgcctttccctagaaaataattgtatatgttaatgaacaagaagtaattactgtgtctaattatagctggtggagtacctaaaaacaaaacaaaacaaaccagtaggtagtggatcaataaatgtgacatataaaggaaaattcccttctataagcatcaaaaaatgatagaggagaacaaagaaaaattaaacaaattaaattaaattaagcaatttcatatgttttaaaatggtggcgaaggaaactcatttcctccatgaaaaaattaaaattttaggtaagactagaagaattcagtataactcctttcccctcaattattgtttttattgccttgctgtggctcattaaatctttatgtattatttgtagaaatgtaaggggtagaatatacaactgcagtttcgttacatggatagactgcacagtggtgaagtctgagcttttagagtaaccatcacctgaatagtgtacattgtacctgttaagtaatttctcgtccctcaccgcccagccccgcccacccttctgagtctccgatgtctgttattgcattctctatatccgtgtgtacacattatttagctcccacttataagtgagaacataggacatttgactgtttctgagttgtttcacatattaaatctttatgatggttttctctcctctcctctccttttctgtctcctattcttttactgcttttttttcctcttctccccttccctttccttctcttcccttcttttgtcttctgtgcattgaaacattgaaggttcattgaagttttctcgttgaaacaagacatcacaagctatttcttttttaacatgaactaattgataccatggcattcatgtagaccaccaggccctagggaaaggaaaatttggaccttccattggaaggagaaaagtctgagggcacactggggtatgctgcccagctctgagttgaaatgggaagttcaaagtgctacacaatgtgacctgggcatggtgctttagagaaagaacagcgaccaaaaatggaatttgggatgctgtagagacaccaagacaaaatcctactcttgtctctgcataaaacctactctataaaacagatcaccaagagtctctaagagtatagataggttgggaattttaggtatgacagtatactattctcacaaagctttgcatccaattagttcttatctcattacaagagtttatggtaaggattttcagcactcacagtagtgcctattgctgtaatcgttatagtactatgctttcaataaaaaatgttaaacatccctgtgcagctgaagacacagatttaaattctttcaaaggatcagatctgttgcaaaacacaaaaaacctggaagatgaagagataacaatacaatcttcatgcaatgcatgtataatagtttgccttattttattcatagtatccaaatactagaaaaatactgtaacttgcatttatactctttttatccctatgaatccagtgcttataaatatgtgtgcatgagttagtgtgtgtagtagacaaatcaatactacttaattctgtaaatgaaagaaaatgtcccaatgactattttacccctgaatatattaaatcatttatacagatcagattgactcaatttttttggcattaaagtggttttttggctatttagataaattactatgatgttgtaattttgaatctattctttaagcctcaaattatcttatatcagtgagaaaagatagttggatcagctatttagcttgcattttattgacgttttactactttctagtaatccactattatattggttccaaagctttctcaaggaaatgtcagttttcattgcataggagagaataaatgtcttcattcatgtgtgtgagcattctagttgttagtaaaatatttccatttctatcagtaaatataattaaattaaatattgcatttaacatgcataggttgattttactttaaaaaaaattttaaatataatagagatgggatctcactctgtttccaaggctggtcttgaacttctgagctcaagcgactgtcccacctcagcctccaaaaatgctgggattacaggtgtgagccaccacactctcctcgattgattttaatcaggcagaaattggtctaaaactgggagacatcatatgtaagtcgaattttgcttatggtgcacccaaccgtagtccatttaaatccttgaaggactaattatggccatcagtgtgaatataatgccttttttaacccaaagaattacttttatgggtaaaatctactttagactgcttttagcttctctgaatactctgagtttgcatttataattttaatgaaaggatcatgatacctgcccaacatggagatcttaaactttcaataaggtgtgatatattcattcatttctttggataccttggggaactgtagcttgatttgttttctctttcaaaataagagtgtgttccacagactgctttctaggtgtgaacacgtgtggtgaggcacgtgctcacaggaaccactgtggctaaggctttgcatttctagaagctgaggataatccgtactctaattggaaaaggacaccttttgctcctttcacctcttgctttctggagcctcagacctgtcctggacatagaataatcccttgatatgattaacagaagactctgagatctgcagaggaaaaagggagagctttgttttccatgaaagacaatctgcagattgggagatgcagactccagtgtaaaacaaaatgagccccggaggacaaagagggggcctggcttaaatcgggaaggttcctgtcccagtcctcaattagacctgtatgtcattacacacacacacacacacacacacacacacacacacacacacacacacacacacacagagagatggatagatagatagatagaatatatatatatatatatatgcacacacacacacatgtatatatatgcttttattttaagtttttaagttcggggtacatgtgcagtatgtgcaggtatgttacataggtaaatgtgtgtcatgggggtttgttgtacaaattatttcatcacccaggtattaagcctggtatccactagctatttttcctgatcctctccctcctcccaccctctgacttctggtaggccccagtctgtgttgttcccttctatgtgtcatgtgttctcatcatttataagtgagaacacacagtatttggttttctcttcctgcattatttggctaaggataatggcctccagctccatccatgtttctgcaaaggacatgatctcattcttttttatagctgcatagtattccatggtgtatatgtaccaaaaatcatatgaacaaaagctcaacatcactgatcattagagaagtgcaaatcaaaaccacaatgagctaccagctcacactagtcagaacggctattattaaaaagtcaaaaaacagcaggtgctggtgaggttgtggagaaaaaggaacacttttacactgttgatgggagtgtgaattagttcaaccattgtggaagatggtgtggcaattcctcaaagacctagagatagaaattccttttgacccagcaatcctattactggatatatatccaaaggaatataaatcattctattataaatatacatgcacgtgtatgttcactgcaccactattcacaatagcaaagacacggaatcaacctaaatgccattaacaatagataaagaaaatatggtacaaatctgtgtgtttaaatgatgtatttaaatttgtttggtctttgaggttgaaaataatgagtactgattaggtagtttctaagctcaaacccagaggtagctgttgggaggaattttccagccagggtttctcagcttcagtgagctaagaaccatctcagctcagcacaagctggatattcagagctgctatctccaggaacaaagtgctttgtgactctcttctctcactccccctggccactgggttccttttatcttaatttgagggtcactctcagccacagagagcccattttgtctggatagttagggttttattaacactttcatttcagaacagcagtagatagctctgcagacattgcccccatgggttgactggaagtttctcctggaaactgtgtcctgtccagagtgagatcaattgtcaggtaaacaatatctctcctgcattagggccagatggggttactctgccctttcctggctgcagacaggcccaagcccagaaggccacagtccctgggccaggggctccaaggctctgcaaacattaaggaaagagcggttggctatatctccactgaaccctttctcttctagagattccccattttctgtgaatctcttgtgtcctggatgtcctgctggagtccaatgcaggaacgagggagaaaattcaggggctccaatgactctggaattagaagagaagttgtgtgcacgtgatgaattttgtgcattttacagcagaggtctttcaatacttcctctgaatttcttgaagttcatgatcaaaactggaaatgagagattccaataagccacatctgttgtacatttgtttgttttattttattttaatttttatttccataggtttttgtggaacaggtggtatttggttacatgagtaagttctttagtggtgattcgtgagattttagtatttgttttattttaaagtcagggtcttgctgtgtttcccaggctggtattgaactcctgggctcaagtgatcctcctccctcagcctcctgagtagctgagactacaagcaagtgccaccatgcctggcttcaatcaattttagaatttgtatgtgcaattctgatgtatcatagtttaagaccttttgtaaaagacagacgtttttgtttcatttttgaccacatggatgacacaagagaacattatgtgaaatgaaacaaagcaggtttagaaaggtaaataatgcatgttctcacttatatgtagaatctaagaaaaaagaactaataaaagcagagagtagaatgatagtttccagaggctgagtggaaggggtcgtggatgagaagatgttggtcaaaggataaagaggaggaataagttcaagagatcttctgtacaacatggcgactatagttaataataccatatagtaaacttaaaaattgctaacagagtagattttaaatattctcatcacaaaaagataagtatgtgaggtggtagatatattatttgtaattttttaaaagaaaatattttcaagacatagcatcacaaataatttaagtgcatttcttattgtgaacatttctttttttttgtttgtttgtttttgagatggagtctcactctgtcgtccaggctggagtgcagtgatgagatctcagctcactgcaacctccacctctcgggttcaagcgattcttgtgcctcaggttcccaagtggctgggattataggcacgtgccaccaagcccggctaatttttgtatttttagtaaagatgggggttcaccatgttggccaggctggtctcgatctcctgacctcaaatgatctgtctgcctcagccttccaaagtgctgggattacaggcatgaaacatcacacccgacccttattgtgaacatttctttacacaacttgtaactacttgccacgttctgagcaaatatttattggttaactatgggaggtaaatcattagcacattatttgttctttgtttttgcaactggttcctggcgtaaaacatgatattggcatgctgctgtgttagtgctcaaagctgatggcctgaaggcatcacctagacctggcagaaagatttgaaaaagggaaaggtatttcagtatgtatacatattttaaaatatattcagagaagtatttgttaaatatttttattttaatagattttgggctacaagtggtttttggttacatggattaattgtagagtggtgaagtctgagattttagtgtgcctgtcatccaagtagtgtgcgttgtatgcaatatatagttttttatccattgccccctaccctcccccttctgagtgtccaatgtccattctaccactctgtatgcctttgcatacccatagtttagctcccacttataagtgagaacatacggtatttgattttccattcctgagttatttcacttagaataatgtcctctagctctatccaaggtgctgcaaaaaacattatctttttttttaaatacatacagctgagtatatatgcaccagtatttcatggtgcatatatactgcatcttattgatccactcattggtccatgggcacttaggtcggttccatatctttgcaattgtgaattgtgctgtgacaaacatatgtgttgcaggtgtctttttgatataatgacttttttcctttgggtagataccaagtagtgggattgctggatcgaatggtagatctacttttagttctttaagttcttttagttcttttagtttcagttctttaagaagtctccaaactgtttccatagaggttgtactaatttacactcccaccagcagtggataagcattcccctttcaccacatctacacgaacatctattattttttgactttttgataatggctatatagaggagtcttaaaaaagcaaagaagcttgatgtattataggaggcagaatgatatcctcacatagatatccacactctaaactccaggacctgtattatgttcattacatggtacagggactttgcaggtaattgatgtcattgaccttacaagagaaaaattatcctacttaaccaggtgggtccaatctaatcacaggtgcccttgaaagcagagaattttctttttctggagaaagagagatggggaggcaaaaggaaaaagcagaaagattccaagggtgagaagagtttaacccaccattgctgcaatgttctgagatggaggagatatctgcaaggaccagcaaaaggactctaacaactgagggtttctccttcttccctccatggcagacagtgaagaaatgaagacttcagtccttcgatggcaagattctgccaagaattcaagtgggcttggaaactgacatccctgaatctccttataaaaactcaggacagctgacaccttgattttagcttagggagacccagagcacagtggtaaggtgagcacacaggacttttgacccacccaatggtgagataataaatagatgtttttaagaggctttgactttgtggtaaaattaccaatttacagatgtatacagaaaattaccaaaattaaattaccaaatttacaaatgtacacagcagctacagaaagtcaatccacttaaatatgtaagtccatcaactccctgtaaatttacttatgaattcaatgccagttcaataaaaatactaaccaagagctgagcatggtggtttttacctgtagtcccaaatacttgggaggctgaggcagggggatcacttgaacccacaagtttgaagctgcagtgacctgtggtcatgccactgcactccagtctgagtgacagagcaggaccctattcctaaaattttatgcacttagaaaacatgattgtaaaggtgacatcaagaaatatacatgcaggaaggattaggacactactgtgaaaataagcagtaccatgctgttttggttactgtaggcttgtagtatagtttgaagtcaggtagtatgaagcctctagctttgttctttttgcttaggattgtctttgctatatgggctcttttttggttccatatgaaatttaaagtagttttttctaattctgtgaagaaagtcaatgatagcttgatgaggatagcattgaatctctaaattactttgggcagtatggccattttcacgatattggttcttcctatccatgagcatggaatgtttctccatttgtttgtgtcctctcttatttacttgagcagtgttttgtagttctccttgaagaggtccttcacattccttgtaagttgtattcctaggtattttattctctttgtagcaattgtgaatgggagttcactcatgatttggctctctgtctgttattggtgtgtaggaatgcttgtgacttttgcacattgattttgaatgctgagactttgctgaagttgcttaccagcttaaggagattttgggctgagacggtggggttttctaaatatacaatcatgtcatccacaaacagagacaatttgacttcctctcttcctatgtgaataccctttacttctttctcttgcctgattgccctggccagaacttccaatactatgttgaataggagtggtgagagagggcatccttgtcttgtgccggttttcaaagggaatgcttccagcttttgcccattcagtatgatattggcagtgggtttgtcataaatatctcttattattctgagataccttccatcaatacccagtttattgagagtttttagcatgaaggggtgttgaattttatcgaatgccttttctgcatctgttgagataatcatgtggtttttgtcattggttctgtttatgtgatggattatgtttattgatttgcatatgtcaaaccagcattgcatcccagggatgaagccaacttgaccatggtggataagctttttgatgtgttgctggattcggtttgccagtattttattgaagattttagcatcaatgttcatcagggatattggcctgaaattttcttcttttattgtgtctctgccaggttttggtatcaggatgatggaggcctcagaaaaaatgccacacatctgcaaccatctgatctttgacaaacctgacaaaaacaagcaatggggaagggattccctacttaataaatggtgttgggaaaactggctagccataggcagaaaactgaaactggaccccttccttacaccttatataaaaattaactcaagacggattaagacttaaacataagacctaaaaccataaaaaccctagaagaaaacctaggcaataccatccaggacataggcgtgggcaaagacttaatgaataaaacaccaaaagtaatggcaacaaaagccaaaattgacaaatgggatcgaattaagctaaagagcttctgcacagcaaaagaaactatcatcggcgtgaacaggcaacctacagaatgggagaaaatttttgtaatctatccatctgacaaagggctaatatccagaatctacaaggaacttaaacaaatttataagaaaaaaacaaacaaccccatcaaaaattgggcaaaggatatgaacagacacttctcaaaagaagacatttacacagttaacaaacatatgaaaaaagctcatcatcactggtcattagagaaacgcaaatcaaaaccacaatgagatacaatctcacaccagttagaatggcaatcattaaaaagtcaggaaacaacagaggatgaggatgtggagaaataggaacacttttacactgttggtggtagtgtagattagttcagtcattatggaagacagtgtggcaattcttcaaggatctagaaccagagataccatttgacacagccatcccattactgggtacccaaagaattataaatcattctagtgtaaagacacatgcacatgtatgtttattgcagcactattcacaacagcaaagacttggaaccaacccaaatgcccatcaatgatagactggataaagaaaatgcggcacatatacaccatggaatactatgcagccataaaaatgaatgagttcatgtcctttgcagggtcatggatgaagctggaaaccatcattctcagcaaagtaacacaggaacagaaaaccaaacaccacatgctctcactcataagtgggagttgaacaatgagaaaacatggacacagggaggggaacatcacacaccagggcctgttgggtggtggggggctgggaagggagagcattaggagaaataactaatgtagacgacgggttgatgggtgcagcaaaccaccatggcatgtgtatacctatgtaacaaacctgcacgttctgcacatgtatcccagaacttaaagtataataaaaaaagaatataaacaatgtcaatgggaagtcagacccattagatattaaaatgttgtattgcacctataattaaaactgctgcattggttcatgagggacccatggaacacaatagaaatccccaaatcagatgtaggattacatagcaatacaatgtttggtaaatgcagcatcacacatcaacagggacaagtgaatgttttagtagattgtatttggacaactgggcagacatttgaaagttaaaagaaaagttaaaataggatgcataacaaatgtataccacaataactaaaatgtctcaaaagataaacctgtaaaaatacgcaacaagttatgtcctagaaataaagaaacctcccattgcttgaatttttaaagcaataaattcactgcatataaatttaatgaatccactgcatataaaactttcacatcacaagacctttcataagtagagtttaaagaaacatggcaagctggaaaagatatttgcagtggaaatcacagacaaaggactctctctaacataatcaagacaaaaaaacttccaaaaaccaaaatctacttaagaagtgtgcaagataaatgaacagatggtcttcaatagaagacatgaaaaaggacctaatatatgaaaatatgttcaaccatgcactctcaatggcagaattgcaaattgacatcatacatagacaccacttctcaacaagcagattggaaaaatgcagaagtttggccacaaaatctgttggccaggctgtgggaaaataggcaccatgtgttgctggtggaaatgcagaatggtaccacactgataggagggaaatttggcaaaatgcatatccagttaccctttgatctatgtctagaaaccaaagccaaagataaatagggtaaaacagagcatctcttttgtacaatgttactcagttgatatggtttggctttgtgtcccctcccaaatctcatctctagttgtaatccccatgtgtcaagagagggacctggtggggatgattggatcatgggggcggtttcccccagtttgttcttatgatagcgagggagttctcatgaaatctgatggttttaaacgtggcagtttcccctgcattctcttttcttccttgccaccatgtaagatgtgccttgcaccttcaccttgcaccatgattgtgaatttcctgaggcctccccagtcatgaggaactatgagtcaattaaacctcttttgtttataaactacccagtctcaggtagtacctttacagcaatgtgagaatggactaatacatcactccggtgtgatctgtaatctcaaagattggaaacatcccaaatgtccctctatagaaaactgattcaacaaactatggtacagagacagaagaaatgtaacggagacaaagtagaaatctaggcattggtatgagtgagctacaggttacattattgagtgaaacaagcaagcacacgaaaaacaacaacaaaaaggcagcccatagaataactgcaagtttatggcaactgttttgggagaaagggaactaactccagttacaacccatatacttacatgcatatgcatatttactcataacagtaaaatttttggaaggataaattagcgaatggcatcagaagcactggtttggtccgttgacctgtaccattctgcaaaaattgcaacagacatcaaagatttagtatttgaatcttccatgattttgatatagtgattcttcaaactatatgatatagatgtgtggatgtagatcaagtattgccatatgagcaaaacagctcatatgactgttaatcgttctttataaatcatattcaattgtcaacacacacatttgtggagtggataactccactgaagatcaacataatcccatctcacttctagttttctttgaaagagttacgcccattggaaatggagatagcatagtcccccaaaaaccatcctcaattctgacaccaatcacaactcaaggggtccttaagatcactctcagttttgataatttgctagaactcatcgaactccctgaaagctcttctactcaggattaggtttattacagaggaaggacagatgaaaattagccgagagaaacagtgcatggggcagagtccagcaggggtctaaatatggagcttccagtgttctcttcattctgcagttatggatggagttgcttccccctggatgtgacacatgaccgtatgcactgtgtattgccaaacagagaagctcagatgagcctttctgtccagtatttaatggagttcaatcacaaacttccacattgctgagctttggtctcaagctcctcctggaggcagagctcatctctagtctacagctcttctggatatggtatggcccaaggacccagccttaaccaccttgttagactgttgggtggccaaagattacaggcaaagacacttctattgaacaggacattccagtggccaggagatcacctttcagggggtgagggctaaggtgagacctctctctttaggtaagaagaacgcttcattacaaatgcaattatatactctgctaagtacatgaattctgaagcatattttgagatatagttggagtaatatctcttgagaaaaagtgcaagagttaaaaccatgatggaacctaaaacttgcaaaatacagattgtagctaaatggcagtactactttttttaaaaaaaatgttaaatacatatgtattttctgagacagggtctcactctgttgcctaggctggagtgcagtggcgtgaccacatcccactgcagcctaaatttttaaatatttagttgacaaaaatgtatgtattcaaggtctagaatgtaatggtcttatgtatgtacacatcttataatgattaccacaatcaaattaactaacatactcattgccacccatagttaccatttgtgtgtgtgtgtgtgtgttcatgtgtgtatgtctgtgtatgttgggaacacttaaaatcaccttgcttatgaaaatttaagaaacatttgtccccatgctatacattaggtcctcagagcttatccatcttataatttcgtttgtaccccttgaccaatatctccagataccttcattcccacgtgcattcacaaaagccaagatatgaaaacaacctaagtgtccatcagcaaatgaatgaatcataaaatgtagtacctatgcagagtgcaacactctccagccttaaaaaagaaggaaaccttgtcaattacaacaacgtggatgaaactgcaggatactatgcttcataaaataagccaggtacagaaagatagatatcgcatgatgtcactcacgtgtgccctctgaaatttgaactcatgaaagcagagagtaatacttttgcaggtagaaagctgtctcttaattccttgaacaacacttagcgggacattggttcatcttcctttaaatctaagcgctttgggtaacaaagaagattgtgctatttatatattagtagaattaacgtgacatttgcatgaaaaccaaagtttttgttttttcagttacatcccgtatacttttatgcatatgcataattgcttataatagtaaaattattggaagagtaaattagcaaacagcatcagaagcactggtttggacagttgacctgtaccattctgcaaaaattgcaacaggcatcagagattttgtatttgaattttccatgggtttgaaatagtagtacttcaaattatatggtgtagacgtatggacgtagatcaagtattgccctatgaacaaaaccgctcccatgactgttaaaagcaaagttgcacgtcattgtgaagaatgtcactattccttcaaaactcattgaaagtctgcttttgaatctgctttcctgagtctccattgatcatcatcagaaaataaatttccaattgtaaaataaaacaggatgggttagatatttctgcctcccagaatcactgtgatgcacctggattcctgaacacattagtgcgtggtttcagaaattttaaaaaatgctccatgaagcgagacatgtgtctcaggttgtatgcatttgttttcttgtaatccagacatgcatggctgggacgtgtatcccaatgaaagcgaaactcccagggtaactctgagcttgttcttccctgcacagcaatcacgccactcacgaatccattgcgtctttgtcttctgaccttcagtatcctgtgcttttttttttcttagcactattatgtatttcgcagatgcaattttctctcaaattgcactttgaataaggtcactcagttcttaattccaaaacttttgacacctcactcgatgttgtcgccggggacctacttgctattctgagatggctgtgcttctgatggctgagaattaacctgaagtgccggtttctgaatgctcgatgcttcttgggagactggagtcgatagtgcctttggtggtgcttcatgccaaatgctgatgcagtctgaggcttggcggaggcaggtggtgagggagggaggtttggaatataaacaaagccttttctgagacaaaactagggactgtgtttaatctcagattggttcacacacttttgtgatgtgcttcttctttagagaaatgtgctttatgtatgtagcacaattaagggatgctattatccttccttgaaatttggaatcaagatagcaagctccatattgattttggacactgtttcccattcatatctagggtcggagaaggatggaaaaatttttggccatacctaaggtggaactggcagaggtggggtttaatccagtgtgaagagaaagggggaagaggtgagcaaagttttttttggagggttgggggaagatgtggtgaggatcagagagtcagggcaccaagctccaattcaaagttgtttgccctgaatttttagttccatgcacatctcagggtgtgctatggcaccattactgggcaatgactctgtttccattctcggtgagctgctgtgtgtgtcctcccctaccgagtttggtctgcagccaaacttttgttgttcctttaaataacttccagttgtactatagagtgaattggaggagtccagcaagagaaaaaacacgcaaatctttttttcttttttttaaagacatggtcttgctctgttgcccaggctggagtgcagtggtgcaatcaaagctcactgtagccttgacctcctgggctcaagcagtcttctcacctcagcctcccgagtagctgggactacagctgtgcaccaccacacccaacttttcttctctttcttttctttctctctttctctcttttctttctttctttctctttctttctttctttctttctttctttctttctttctttctttctttctttccttccttccttccttccttccttccttccttccttccttccttccttccttccttccttccttcctttctttctttcttttcagacaaggtctccctatgttttctaggctggtctccaattcctgagctcaagcaatcctcctacctcagactcccaaagtgctgggattacgagagtaagccactgtgcccggccaaaacaagcaactttgtgagttagttgaggcagcagatggctctgggtagactctgacaagtatagtggataaaattgtgtttccctccaaaaaatgatatgtctgcatcctagcaccagcacctgtgaatgtgatcttatttgaaaacagagtttttgaaaatgtaatcaagttacaatgagataggtcattctgggttagagtgagctccagtgcaatgactggtattcttataagaaggtggaaatttctggccagtcatggtggcttacacctgtaatccaagcactttggaaggccaagacaggaggatcatttgaagccaggaatttgagaccatactgggcaacatagtgagatcccatctctacaaaaaattagaagagcttaaccaggtgtggtgggcacgcctgtattcgcagctacttgggaggctgagatgggaggatcacttgagcccacaagttggaggctgcagtgagctatgatcacaccgctgcagtccagcctgggttacagagaggccccatggtttttttgttttgttttgttttttgtttttgttttgcttttctaagacggaaatttggacacagacacacagaaaagaaggtctcatgacgacagaatcagaaattagagtgatgcattgacaagtcaaggaacaccagcaagcactagtagctggggcagaggcgtgggacagattctgtctcagatcctccaggaggaaacaacgctgcccacactttggtttcagatttctcgtccccagtaaatttctgttcttttaagccacccagtgtgtggtactttgttacggtagccttaagaaactaagccaaggaaggaacatgaaaaaatgacttttgaagctgcctacttctcagatatcaaaaggcagagggaagtattcgctgtgaccaggaccaagagatatgacatctgtgccatttggcaccacagaggttctcatggattggaaaagtggtggggaggatgctcagatgctgagaaataggggtgtgcactacacgacactagaggaagagccgcaatgaccagccagtgtggtgaaggtagctcttcctggtggatgcaatgatagcaaaattgcaagtgaaggcagaaggtgctcactgagacttgaaagcttgagcagatgccccttgatattaaagatcctgtgggaaaaggactccagggattcagcatataagagcaaagatatttccacttttaaacccttaaatactgtaaagaaaacactatctgttctcataaacagtggaagcagagagtgaggatattttaggatgccaaggtctttgttaacctcaaaaatctctggattgccagttacattttaaaaatgtccatttctacctatatcttctttattaagttactgcctcaaaattctgttgtttttctcgtgactgtctatcctttttttatacaggctattcagtaagaattctaggccttgcattgtggagaacagtttggagatttctcggagaacttaaaatagaactaccatttgacctagcaatcacattactgggtgtctacccaaaagaaaacaaatcgttctaccagaaagtcacatgcactcgtatgttcatttcacaacagcaaagacatgtaatcaacctaagtacccaccaacagtggactggataaagaaaatgtggaacatatacaccatggagtagcacgcagctgtgaaaaggaacaagatcatatcctttgcagcaacgtagatggagttgaaggccattatcgtaagaaaattaatgcaggaaaagaaaaccaaatgccaaatgttctcacttataagtaggagctaaatactgagtacacatggacataaagatgggaacaataggcactggggactaccagaggctgaagggtgaggaggggggccagggttgaaaaactaactattgagtattgtgctcaatacctgggtgatgggttccttcactccacaaacctcagcatcacacaatttgcccagataacaaacctgcacgtgtaccccctgagtctaaaatggaagttgaaattatcgtttttaaaaaagaacccaggcttcaatcacagaagccagcaattgaaaccctgctttcatgcttacttactgagtggttttggagttattaaagtttcactgttctctgagccttaattgataatattgatagcataaggctggtagtacctacttcctcatgttgttatgaaaattaaaattgacagtttgtgaaatgcactggatatatccttgtaatgcactcatatgttcattgcactaactccgtggtcctaagtgggctgtatactttcatgaagctcctgattctgtgtaagaagtatgggtgaaaattgctaggtgttcttaaaagcttagacaggaaaagagaagaaagatttcttctgacttataaagtataacacaagactgattgggtcagatcaaccatatgcaaattcacctaaaagaggtttgttttaaggaaaatataaatttagcttacattgtgttatgtcactaaagctagaggaaaatgacataccattggagtgttgtcaattatggaattacagatacaggagagtcttgggacaaaactcataaatatccatccaaaatatttatcaggagagaagaatcattctaagagtgctagacactaagaataaagatatatatgtat[217 bp omitted]gcaggagaattgcttgaacccgagaggcggaggt[132 bp omitted]tagcttggtctgattctatgttcagaaaacaacccttattagtttttaaagacagggtcttgatctgttgcccaggctggagtgtagtggcacaatcatagctcactgtagccttgacctcctgagctcctgtgatcctcctgtctcagcttccaagtagctataggtgcgtgccactacatttggctaaatttttagtttattattattattattattatttaatttttctgcagagatggggatctcactgtgtttcccaggctggtctcaaactcctaggctcaagcaatcttcctaccttagtgtctcaaagttctgggattacaggcattgagtcaccatgcctggccggaatgcaacttttaaattgtactttggtttcccacataaatttgcttagatgcattttctggtctaattgttaaatttcccacttggaaaaaaaaaaaaagagagagagagagagagacaggctcatgcctgtgatcccagcactttgggaggctgaggcaaatggatcacttgaggtcaggagttcgagaccagtctggccaacatggtgaaatcccatctctactaaaaatacaaaacttagccaggcgtggtggcgtgtacctctagtcccagctacttgggaggctgaggcacaagaatcacttgaaccgggaggcagaggttgcagtgagcccagatcatgccactgcactccagtctgggtgacagagggagaatttgtctcaaaataaaaataaaaaataaaaaaggaagcaacacacaaataagcatacttgtgttgtacagcaatcccactggttaatactgtttcactgctgaacagtacattcagttttaatttctgaggtttcagactgaagaccagaccttgcaccaggattctattcatccatgtgagacatttggggctgtttggtcatcttttgataacctccttcttaatgtctctgcattagttagctatgctgtgcaacaaaataccacaaacttggcaacttaaagtggcatgcatttattagctcgttatatgaggctgagatgtcttgcatggcttactgggttctgtgttctaggtcttcccagggtacagttgaggagttgcccagactgtgttgtttttctggaactcagggtgttcctccaagctcacgcagttgttgcttgaattcagttgaagttgcagaacttgaagccatattcactgagtgtcttccaggttcctgcaacatcaatgaatctccttttttgggagagacaggttcttactgtgtcatcacttaggctgcagtgcagtggtgcgatcatggctcactgcagccttgacctcctgagcttgagtaagcccccagcctcagactcccaagtagctggtactacaggtgtgtgccactacactcagctatttttttttttttttaaatttcttgtagagacagaggtctcgctatgttacccaggctggagtacagtggcatgatcatagctcactgcagcctcaaactcctgggcttacgcgatcctcccaccttagcctcccaagttgctaggattacaggcacatgccaccatgcccagttaatttttgtatcttttgtggggatggtctctcactctgttgacatgattccgttatataggtagttcacaacatagtagcttacttcttcaaggtcaccgggataatctttcacacaggctgttaagacatagtctttgatgaacataatctaattatgaatgcaccatcacttgtgtcatattccattggttagaagcaagttacaggtctgttggcacaaaaaataaaggagagtattcaatggtggagtcgttggggttcatcttggtgtgttcaccacagactcctgatgtattatttttctcaatggattcctggtcaaatgtcaatttttaaccacaaaaaggttgttaagaggacaaaattatatttagtggggttattgtcctcaatttccgtgtgagtttctgctgaggatcctgaatcacccagcaagggagaatagaccacatatcggtaggaaatggcaaaccaactggtcacattccattctccacatctgacaaaacttggaagaagttcactcaagggaatgtgaattgcagttaaaaaaacaattaaagtagtgacacttttctgctgcttttaatatgcactcattgttaatgaaatgctagtccctttctttgtgtaaactatcaaatctcatgtcctcatgtctgatgtgttagcatattgtttgtgtgattacatgtggtgtcacaacatcatgaatgaatcctatttttaatgtactgcataaagaacaagcagggattataaagtgagattgtcacttttttaaaaaaaaatttttagacagggtctcattctgttacctagactggagtgcagtggtgcaatcatagcttactgcagcctcaacctcctgagctcacatgatcctcccacctcagccacccgagtagctgggactacaggcccacaccacaatgcccagctaagttttgcgtttttttgtagagagggggttttgtcatgttgcctaggctagtcttcaactactgagctcaagtgatccacccacctcggcttcccaaagtgctgggattgcaggagtgcaccactgcacctggccagattgtcactttaattgcaccaacaaattaatacagatcacagagaggttgacattcatctattaatgtattgccatgcttaaaagaccagctgtatttattttgcctcaaatgcatcttctctggccagtgtataggttttgttttctaaatagggcatcttctattaagaataatgcaacggtcatttaaatcttcaccagtagtgaccttgctctcactccatgaattaagttatcagatttatcctgtagttcaggcacaaatgaattatgactgagggcaaatcttatattattagatgggggcagtgggacttgcagatgcaattgatggaattataggagcatcacatatgcagaccaggttattattaaagtcgagatcactttggttttcaagtctctcccactgttagttttccccagagtttattcttaaggattttcttgatatcagtgggtgcagaacgaattaagaacattaccaaaattatgtaaatgtttgtgtctactgcctgttagctatgatgtggttgagatggaagcatcaattttaacctgtctcaagaccgagccatgtctttaattaaagtagaaccattggaatcctacgcatgcacaattactcagcatacactccaaaacccttatcttattttaaaaatgtttttatctgtatacatgtaagaggtacaagtgcagttttgttacacaggtacattgcatagttgtgaagtctaggcttttaatgtaaccatcacttgaatggtgaacattgcatccaataggtaatttttcatccctcactcctccttcccaacccaatccttctcagtctctaatgcccatgattctacactctatgtcttcctgtacacattatttaggtcgcacttataagtgagaatttatggtatttgactttctgtttctgtgttatttcacttacgagaatggctttcagttcaagccatgttgcatcaaaagacacaatttatttatttatttttgtcccagaatttattcttgaggattttcttgatatcagtgggtggagcatgaattaagaacactaccaaaattatgtgtaattttctttatccaatcattttctttatccaatcgcattttctttctccagtcatctgttggacacttaggttgattccatatctttgctattgtgaatagtgttacaataaacatatgagtgcagatgtctttttgacagggtggtttcttgtccctttaatgcactctatttgtgtaggaccaagaatcaagatgttcctgtaagtcaagagcattttttcgtgttccccctcagtcaccaagtaagctgtgttgctcagggaaaaagttcttccaattatttgcactggggtttgagctaaaaatgagctaaaaatgggttttcattaccaaggataaactacattgttttacttactttctaccatttgtttgcaggagttccatttgtgcccaaactttacttccccagaagtttaaaggcggtgtctcaggatgactcatgctaaatcttacgtgaatagccctgctattctacatgcaaggttgctcgtgggtgctattgattttggaatctgcatccaagctgggtctcttggcccccgccacaatgcaggggcatctcagcacatgcagcctctgatgagaccaaattctctcaagctctcagaggactcaatttgttaaagcaatgctatagtctatgcagaattgataagaaacagtcaccctcccttctaagctctgcttgttgatatgagcagcttagaggcaaatctgagtctaatgtcttgcccaagtgcacatcagtcgtttcattgcagataaataataattggtgacccaaaaatatgacgcttgatggatcatgagatagaaacttgaagaaagaaagaaagaaaaagaacagatattctgctccatttatcaaatgaacctaatactgtttattaagagtaagtttaaaatcagacactaataatatgtgagaaaaatgttacttttgtttgggggtaatgccagtgatggcttatgaaatcatagaatttatcattaaactttccattttccattggtcctaatggaaggacctatgttcctattctgaattgaaggtctcttttgccatgcacatgacatatgggtaatatttaattagactgaataaattagaggaatgatatctgctttcaagtcccagagcattctggcttttcttctatggactgacttcatggctctcctaattatctccttggccttggttagttaactgggttaagaggtcagaagatcttaaaacaaaaacagtattcctaacttgatttttctcaccctcattaatttttagaaggatgctttaaagtaggaatattactttcttcctatgtttgaaatatggatcaagagacttgcatttggaccacacttcttggaaatggacggggccccccaaagcagtcccttgaatatctgcacatttaataaatgagcgtattcattggacattttctttactgggcatggcagatcggtcttgaccatactctacttttttttagagtgaagccatttttcttgagttgcagagcagttgctgcagtattaaatcagagttgttgtggcagaaccaggcacatacgggcgataaaatgcccagattggagctgattggtatatcaaattatgggaggattatccaggctgacaacgtgacgggtttatcttgcctcaaaaatggaaatgttacttccttccactgcaggatggcttattaataagaacatcagtggatgagtgggcttgctggggaggaggaaggatgaaggagtttaccttgttcaaggacaagtcagattttcttctctgtaaaaaaggaaggcaggtctggcaccgtggcttatgcctgtaatcttagtactttgggaggccaaggcagggggattgcttaagccaaggagagggagaccagcctgggcaccatagtgagaccctatctctacaaaaaaatttaaaagctgggtgtggtggtgagcacatgtggtcctagctacttgggaggctgaggtgggagaatcacttgagcccagaagttggaggttgcagtgagccgggactgtgccactgcactccagcctgagtgacagagtgaaaaaaattttaaaaagtgagaaataaaaaaggaaagcaggtaaattatatgtataccaggtaatatggtgatttgctggacatttggttacaaagtaaaagggagagtaaaacttagggaataatagagaacattattaaaaatcaaactcaccaattctctagaaaacgcaatagagaaagaaaggactgaactaggtgtattagtctgttttcatgctgctgataaagacatacccaagactgggcaatttacaaaagaaagtggtgtaatggatgtacagttccatgtggctggggaagtctcacaattatgacagaaggcaaggaggaacatgtcatgtcttacatggatggcagcaggcaaagagaaagagcttgtgcagggaaactcctgttcttaaaaccatcagatctcgtgagacttattcactatcacaagagcagcacgggaaagacccgccctcatgattcaattacctcccaccaggtccctcccacaacacgtgggaattcaagatgagatttgggtggggacacagccaaaccatatcactaggtgattgtttttcttctcttgtttcactggtcttagtctccttggcctcagctagaccataagaaagagcaaacgtgtgctttgttgttatttattactatctgatccaatcatgatattttagagccagttttcttctcctgaaaacctggggcagtttgcatcataaaccacagcaagagagatcaacagtgattaagtggcaagcagtgctactgagaacaagtttttcacaacacgctaaagtcatacagtgcagagcttccctaagcacccaagaaacacattcaacacccttagagccaagagacaagaagcttggagtcctgttggtttcatgaatactctaggagtatgaaggacccagcaggggcctgagatgggaaaataattatgtaaactcagatggccagggatgttgtttgaacaaatcataggatgggatgttgtttgaacaaatcatagctccacaaatcccctttaaaactgcagtctggcatgaaaagccctattagaatttcaaaacaaggtagcctccaatcttcacaaagctgcactttggggatcagagcagggattcccaggagaacaccacagaaccataatcactctactctgctagagtaaacttttttttttggacattcaggttgctttcaagtgcatttcacaaactcctgggtcatggtggtgggcagattttcaggtggccctcaggaccttcacctcctggagttcatgcccttcaacaacccactcatcttgaatgtgggcaggaggtgtgaccaatgaaaaatggctatggtgatgagttgtctgtcactcccaggactacatcttcctaggtgactctctatggtcttgttctccttgctgactttgtagatatgagcttccatttgtcctgaatacagtaggaaatgaattctgccaataacccaagatagctgggaagagaacccttttccagttatgaagacacagctatggctgacctctgattgcagtattacttagcattactaaggcctttcaagactgaataatattccattgtgcatgtatatcccattttatttatccattcatccattgatggacaattaggttgattccatatcttggttattgtgaatagtgctgcaatgcacgtggaagtgcagacatctctacaacatactgatttccattcttttgggtacatacccagaagtgcaattgctggatcatctggagttctatttttaattttttttttctttttgtggaaactccatgctgttttgtataatggctgcactaatttaccttcctggcaacagtgtgatagggttccctttctccacattctcaacaacacttgtcgtattttgtcttttctttttctttttaaagtatgaatgtttacagtggctttatttgtaaagacaaaatatggaaaaacgtcagatgtccttcatcaggttaatgaatgaactaaagcaggggtccccaaggccatgaagggtccaggccatggagcagtaacaatccatggcccattaggaactgggccatataacaagaggtgagtggtgagcgagtgaagcttcatctctatttacagccactccccattgctcacattaccacctgaactttgcctcctgtcagatcagcagcagcattagattctcataggagtgtgaaccctattatgaaatgtgtttgcgaaggatctaggttgtgcattcattatgagaatctaatgcctgatgatctgtcatgtctcccatcacccccaggtgggactgttcagttgcaggaaaagaaactcagggcttccactgattctacattatagtgagttgtataattatttcattatatattatgatgtaacaatgatagaaataaagtgcacaataaatgtaatgcacttaaatcatcccaaaactatactggccccagccctcaacctccactcagtccatggaaaaattgtcttccacgaaaccagtccctggtgccaaaaaggttggggaccactgaactaaaggtagtaaatccatccataaaatgtattgctactcattaaaaaaaagtaatgaactgctgaaacatgctacaatgtggaagaatctcaaaataattttgctaacatagaaactagagaaaaaactacataggttttattacaattatacaaaatttcagaaaatctaaactaatttttcagtttggctggaagttttttctcacgagtcagcctagggttagatttggctttcttgtcaatcaccatctgacaagaatagaaatagattcacagttcttggcattgccaatgtgttcgtgacctttaagacttatctaaccacaaaagtaactggcaagctgtaatctatgcccttttgataatagccatcttaacaggtgtgggctgatgtctccttaaagtttaaatttgcatttccctgatgattaatgatgttgagcctttttttttttatatgcttgttggccctttgcatgtctcttgagacaagtgtcttttaaaagtgattatacccttctgtttaacaggtaattttatcacacagagatgctgctactttcaatattgttcttttcatggattaaatactgcataacaatttctctatttaaatattcactccatatgtgtttagtttatagtataaattttccaaattgtacaatctggtagtcctatgtacatgatggtcttttctcatccacatcttctaaagaatcccctccaagaaggcttccacaaatactggggccatgtcattctgcagaaaatttcttgccaactccagccttggctaaacccagcattattttttccattcatcactgcggagaaaatagggaaaaaatgtaaattacaacactgggtcgaatgttttgctttttatttcattaatttcactgggacactcaaggatgcttggcaacctg[175 bp omitted]gtggcgggcgcctgtaatcccagctactcgggaggctgaggc[131 bp omitted]aagatgaaacactttgtccacatcagctttcataagtattgtttattcttatcaagccctcaagcctattttaactctttcctttaaaaaagcagcttcattatggtataattcgcataccacaaattataccctcttaaaatttggtgagttttgacaaatgtttactcatggttaatcagaaaaaccaccaaaatatatgatgtttccatcaacttaaagattcttttcagtatttttgcaattggcatatcttccactcccctcattctctggaagctactaatctgctttggctatctagttctgtatacagtttgctttttctagatttaaataggaacaaaattacacggctttcattttgttttttcttagatttttttaaaacttagagttatgttttgagatgcatcttgcggtttccatgcagacggcacaatcaacaactccctccaatgtcaagtttggttaggatgtatagactgatgacaccacatgccccaagagaatatgacatttgttattcacataatgagactttatggggaactgtggagtcaggggatgacacaaatttgtccagaatgatttgagcaaggcagcaaatggtgactttggtttttattattattaggtggcaccagctggggtttgcatggtttgaactactcactgtcactaggagaggttgcatgcagatattgtcatcagtttgcccagatgtggaggccaaaggagaagatgtaggtcgggctcgaaaactctcatgtatcaaatgtgaagtcagaatatacaaaaaactaaaacaacagtaaataaaacaaataatgccatttaaaaatgggcaaaggaaataaagagacatttctccaaagaagatatataaatggccaacaggtatatgaaaaaatactcatcataactatcatcaaggaaatgcaaatcaaacccgctatgagatatcatctcaaccaaggtagaatggctattaataaaatacaaaaagtaacagataatgtcgaggatgtggagaaaaaggaattcttatacactgttggtgggaatgtaaattagtacagccgccatagagaacagtatggagatttatcagaagactaaaaatagaattacaataagatccagcattccaactcctgggtatttattcaaaggaaaagaaatcaatatctcacaaagatacctgcacctccatgtttattgcagcactatttacaatagcaaagatatggaatcaacctaagtgttcatcagtggatgattggataaagaaaacatggtacataaacacaatggaatcctattcagccataaaaagactaaaatcataaaccaggcacagaaagacaaatatctcatattttcacttatacatgggagataaaaaagtggatctcatggagttagagacgggttatgttatgggaatgggggatgagggaggttagttaacccttttcccatttgccaggggcaacttaccaggggcacttggggctgcggtgtttacaacgagacaactttgccctgtaatatctcacttttattattattttcacattgctctagtatgtcgactttgggaacaaaacacagcattgtatttttagtagtggcaattccatttacaaaaatatagcaattcttcattgctgaaaatgttaaatcctagaaaacatagcattcctacatgtgatgttaacattgatctctaacagttgttggctgaagtttcatttcatgaatccagttttcctgaaatagacgactctgatgattcaggtgattcttatgctagttctgtttacaaataacaccaataacagtttttatatcttatgttcacattgaaaatcagtcagacttgctttggcctcaaagagcgtatttctgtaaaattaaataagcactgacagaaagctgcacttttattttctaaatggtaaaagtagcgggtactaacatatatttaggtagaaaaaagaagttattatgttcaatagcagggtaaggtgactatatttaacaacaatgcaatatcgataaacttttagctagacttctcaaggaaaaaataaaattaaaattaatttttaaaacagaaacatccaagttgtatgtgagcagtttcttcctacttattgctgagtagtagatgatattggaaacagaccatgaattgtttatccagttaactgataatgaatatttagcttatttctagttcgatgctattaggaataatgctaccatgaatgttagcatcaaagtctttctgtggacatgttcttatttctcttaggaatttctgtcctaggtatttcactaggtcatattgtaaagggataggtaattttataagaaattggcaaactgttttcccaagtggttgtgacatttttacactctcacaagaaaaatccgacagttccagtttctccccttcatcacctacgtatggtatttttagatctgtttgtttcttgctttcagactttctaatgatttaatgataatctcattgtagttttaatttgcatttgtactgatgtgcgtcttttcatgcgctattgattattaatatgacttcatttgagaaatgtctattccaatatttgcccattaaaaattacattattggacttgagttgtgagagttaattatatttagaatacataaactttgtgagacacataatttcatttggttaattattctctaatgtcttttaacaatgttttgtaattttctgtgtacaggttttgcacataatttgttaaatatataagtatttcatttttgatgtaactgtaaatgcttcgcaattgaattttcattaggttttggcttgtataaatcatacacttggtttcacatatttcccttattttcagttccttggttaatgctctcattatttccgtgggcttttttgaagagtctttaagatttgctgcatgcacgataattacatcttcaaataaagacaggttcactactttcttgctagagtatataaaatttctttttctttatttagttaatggcttgaacacccagtgccatgttaaagaaaaatgggtcttagaggaagagcattcagtttttcatcaataattatgaagttagctgtcctttttctttgtagatgtctttttgaggttaattaattcattttctattcctagtttgctgaagtctgtttttataactgtgtttgtcacatttttttctgcgtcctttgaaatttttttcttattctgtaaatatggtgacttgcattaatttattttttttagtactgaatcttctttccattcctgggataaagctcaattggtccttatttatcatgtattttatatatattacctggtttaattttctaaaatttctgtcaaggatttctgcatttacgtttatgagagatattggtaatgtcttttctggttttaatagcagaataatgtgtgtttcataagatgaattggaagatgttccttccttttcattttttggaagagtttatgtagtattggttttatttctttattataaatttggtagaatttaccagtgaaactgactggtttcagagtttttcttgtggtgagctattaataattaattccattttcttaatagatttggcctattcatcttttccatttcgtaccgtatccgtttcagttacatatttcaagaatttaccatttttcttcaagattttatattggtttactcaaagtccttcatagtatttccttattatgtttttaaagtttgtagaatctgtaataatttatattataaaatccctgacattgttaaattctgtctttttttccttgagaagtctagctaaaagtgttatcaattttatgaatctttactaaagaatcatcttttggtttcattgattttcttgtttccttctttttctattttgattatttctttttatattgttactttcactcttttacttagcttttgtttaacttttagttttttttttcttttttctagcttcttcaatgggaaacttaggtttgggaaactttcttattttataagattatttaaagctttaagtttccctgtaagcattaagctttagctgaaaactaccacttttatactgtgttttaattttcattcagtcaacatatttttctacttcccttgcaattatttttttcttcttcctgtggactatttagaaatgtgctttaaattccaaataggggattactagttgtgtgtgtgtgtgtatgtgtgtgtgtgcatgtgtttcaattttaactccaccatgctcagacttcaatcattttaaatttatggggacttatttctcagctcggcatgtggtgaatcttaatgaatgccttctgggcacttaaaaataatgtattttatcattatggaatatagagttctataaatgtcacctatgttaatattgctgctcatagatgctatattcttgttgattttctacctacttgttctagcatttactgactggggagtcttggaatctctaaatgtaattgtgggtttatctatttctccttgcagttctgtcagtttttttttttttttaatgtgtgtgtgctgaagttcttgtattaccaagtgcatacacactcacaattgttataatagattgactcttgtttccttttgaaattcccctctttatctttgctaatagttcttggcctgaagtgtactttgtctgagattaatattgtttctttgcttttctacaattaacacttaaatcacatgctttttttctgttgttttcttttaaccccttgtgagattttgtttttaaattgtatttcttgtagaatgtaattagtaacaagcctgcacatgtacccctgaaactaaaatacaagtttaaaaaaagaatgtaattacttcttttgtgtgtgcgtgtcctgtctgatcatctgtggttttattggcatgcttattttcagtaataaaatcatgaatatggttggatgcaactctactctcttgctattttttttttaaattcatcttatttgttctccgtttctcctcagcttttctgccttcttttagattcagtgtttaaatttgccattttatctctctattgccttatgagtgattctttctactttatttatttttggggacttctctagggctgcactatccaattcggtagtctctggccgcatatcaccttgagctcttgcagtgtggctaatataactgagcaattcatttttaattttatttcaattattttaaatttaaatttaaaaaatgaaagcagtataaaatagtttgctattaagcagaattttattattttgttaggactatattttattttaattgttgccttgtgtaagatctttttgttatattgtcctattcgtgttgagtgagtgcgtagtttttcccattacacatacactagtcccagatgtcatcaggatcaacagattgattcagtttgaataatcttttatagactgatatagcattgttatttgttgatttttgtgtttttttttgagtcaacaacatttgtggtgatacgtctgtaaatagtaacaagtaattacatagaaatatttattattttaatcataacataattaaatcattttgtaatttataaagtgtctgcatattttaaaatgtacaatgaaggcacagaattgtgtagaaatgctaaagtgaaaatgaagacccgaattgcaaggaacaaagagatctgaagaaggcacattgcaaatatcctgaatgtcacttgaaattttctgtgacagcgaaaaaccataaagttgtctgtttgctgtaaaacaaaaattaaatgacagtaaacaggacaatattaagagatgcttttagtaaatccaaaatgaatttaattgaaagtggatattttcctcaaaaatcaaaaaagataaataaagttagtcatctgaaatctgaaataaatgcttaaacaatgggtaatgatttttcacaatgtctgaataggtgacaacagtcagttatatagtggcttgaatttatgtgcacatctccctctctctttttctcatagagatagaaagatggcaaaataaataattattttggctatgaagatatttggctggaaacgtatgagaaagagactaaaaattatcttacaaaatgcaaaagagagagattttcaataaagtccccagacaactttccatgggatgcaacacctttctaatgacattggagatcgattaattcaaaattagaaccattaaaagtgtatttctctcccgggcatgatggctcatacctgtaatcctagcactttgggaggcccaggtgggcgaatcatttgaggtcaggagttcgagaccagcctgaccaacatggtgaaaccctgtctctgctaaaaatacaaaaattgtctgggcatggtagtacatgcttataatccagctacttgggaggctgaggcaggaggatcacttgaacccaggaggcagaggctgcagtgagccaagatcagcctctgcactccagcctgggcgacagagcaagactccgtcacaaaaaaaaaaaaaaaaaaaaaaagaaagtatttatttagcttttggtgatttgtgtacaataatataaaggacactgtctaattcatagtttgggaacgttttgtttcaaaagactgaagtttatgaaaaaaaaaaaatcacctggcagtctaatatcaaattcatggtattaccggaaaggggtcctgatctagaccccaagagagggttcttgaatttcacacaagaaagaattcacatgaatccatagagtaaagcgaaagtaagtttattaagaaagtaaagggataaaaagaatggctactccatagacagagcagtggcatgggctgcttgactgagtatacttacagttatttcttgattataggctatacaaggggtggattattcatgagttttccaggaaaggggtgggcaattcctggaactgagttcctccccttttacaccacatagagtaacttccggacattgccatggcatttgtaaactgtcctggtgctgatgaaagtgtctttcagcagctaatgcattataactagcgcataatgagcagtgagcacaaccagagtcactttcctcccatcttggttttggtgggttctggccagcttctttactgcaacctgttttatcagcaaggtctttgtgccctgtatcttgtgctgacctcctatctcatcctgtgactaagaatgcctaacctcctgggaatgcagcccagcaggtctcagcctcatttcacccagccccctgttcaagatggagtctctctgttcaaaggcctctgacaatgagggcagagatcaaggagagatcacacccgggcagggttgggtctacagctctttgttatttttccagtgtcccaaatggagctctggacaaagaaggtttcaaaacacagatattgcgtggggtttcctgacattattgggaatcctcagtcactcggatgtatgaaaccaacttactgtaatattaaagcaaaagcaaacaacagaaactgaatgaaaaccttgcaatctgtcaatcttctctgactaagttttcactccttaacaggacacagaacctagagtcctctggtcattactccccccctacacccccgacaattaacccgtgaatgttgagcacattctcacctggttactctgtttcattaatttcctccattgttttgttaaacactcctgcaaacaaacaaactctccctttttcttaaaaatgccagagacatctacctgatttatcattggaatgactttctctctgaaaataactgttttttttttttttttttttcactctggttattctctcgcatttctaactattggtccaggaacttgagtctatattttctttgtaatggcatttgtcagaccatgactcttgtagcctcttctaaaatctccactattctaaaattgaacatttggccatataaccatctacacatcctttccaccattttatccaccaatactctttcaatggtgttaacttcgaatcggtgaatctccaataccattagaaaggtgctgcatctcatgggaaattgtctggggacttcactgaaaatctctcttttgcattttgtaaaataattgtttagtgtctttctcatacttttctaaccaaatattttcatagccaaaataatgatttatttcttccatttttctatctctgtgtatgtgtgtgagagaaaaatgtggacacaaattgaagccattatataagtggctgttgtcatatgctcagaccctgtgaaaaatcattacacattgtttaagcatttgtttcagatttcagatgactgattctattgatcttctttgactattgaaaaaaaaacacttatagttaaattcattttggatttactaaaagcatcttttaagagataccatctaacgccagtcagaatggctattaataaaaagtcaaaaaataagagatgctggcaaggttgtggaggaaaaggaacgcttatacactgttgatgggagtgtaaattagttcaaccattgtggaagacagtgtgacaattcttcaaagacctaaagccagaaataccattcaacccagcaattccattactgggtatatacccaaaggaatataaatcattctattataaagacacatgcacatgcatgttcactgcagcactattcacaataacagagacatggaatcagcctaaatgcccatcagcgatagactagataaagaaaatatggtacatatgcaccatggaatactatgcagccataaaaaagaatgagatcaagttctttgcagtgacatggttggagctggaggctattatcctaagcaaactaatgcaggaacagaaagccaaatactgcatgttctcacttataagtggaagctaaatgatgagaacacatggacacacagaggggaccaacatacattggagccttttggagggtagagggtgggaggaggaagaggatctggaaaataattaatgagtattaggcttaatacctgagtgatgaaataattgtttcaacaaacacccatgacacaagtttacctatgcacttgtaccctggaacttaaatgttttttaaaaaattccagtttactgtcatttaatttttttacagcaaaaaaacaactattgttttttcctatcacagaaaatttcaagtgacattcaggaaatttacaatgtgccttctttagatctctttgtcccttgccattttggtcttcattccagcttttgctaaaccctagctccaggtttcgtgaacaaccatcacagtaggtcctccatgtttctttcctggtgagctcacctttgtgtccctctgaagccacctagaatcctttcatcttgcaatgactaagtctagacttcttgttcttcatcttccagaaatttgacatttgcagtccacagacccaagcattcacactgtctaggaaactgatgcatgtgtcagaaataaagcatgtcagactccacctgcaaacctacttctctgggatatccccctaccaggggttgatttagttggtcgtcaacaatctctggcattctttctcctttcacaactttgcacatctttccagtgtgcatccgaaattgagaaaccagagcccaaaccaccaaacatacttgtcctaggttccattgcttctcagagagtctccctactggaaaggcgtcttagacatatcttctcatgaggttaaatgtcagtcctgaagttggtataaatgaatcactaactttaaaatatctggaactgttgcagatcatgaagttttgttcaagcaatcctataactacctctactaggcagctgccaattctcttcataaacacaaccaaccttcaccttgaattcaggcttgataagggatttgcactgaactcctcttcaatcagtagagtagttctttgctgaatacagtaaacctgtcaacactgaaaatgttctacaaagaaggaaatgacagatactggggtctacttgtgggggaaggatgggaggagggagaggaataggaaagataactattgggtactgggcttaaaaccagggtgatgaaataatctgcacgacaaacacctgtgacacatgtttactgatgtaacaaaccttcccatgtacccccaaacctaaaataaaagtcgaaaaaaagaaaatgttctattactttaagaaaaaactctgatttcaacttatcgttacattttaataatactattaaatttatttataaataaatattaaaagtaatactattaaatttatttataaataaatagtattaaaaataatactattaaatattccagtactcacagtctgtttagttgtgagaaaacgactttgtttaaagtgcttggtatttcttcaaatgttacacataactaagatttaaatcagcagcccccaacctttttggcaccagggattggtttagtggaagacaatttttccacagacagtggtggcgggattgtgggggatggttttgggatgattcaagcacattacatctattggacactgatttctatttttattccattgtaatatataattaaataattatacgactcaccatcatgtagaatcagtgggagccctgagcttgttttcatgcaactagacagtcccatctgggggcgatgggagacagtgacagatcatcaggcattagattctcataaggagcatgcaatttagatatctcgcatgcacagttcacaatagagttcttgctcctatgagaatcatgccgctgctgatctgacaggaggcagagctcaggcagtgatgagagagatggggagtggctataaatacagatgaagctttgcttgctcaaccatggctcacaggccatggacgagtagtggtccatggcccaggggccggggacccctgatttaaagcatccctgtatcttagataatgtgcaaatagcacatgtctaaggtttggttctcaagcaacaggacctgggctgagtattcttgtttggtgaggtactgagcaaatgctttcaggagaaacccataaaaagcaaagaaaagcaggtggagaagaccaggagtcctcagtttgatcctacagggagctgtacagtctaagtggtcccagagggtattcctcacccagagcaaatgaagcagagctgcattggtcagatgtttgctagcagttaacttaggatgtgtgcaggaatatcaactcccagtcatctccaggtgaggtagaagcaaataaatggttctttgaaaaagagtgcaggtatgaatttatagcagcaacagcacagcatctctataaagaggatttgcatggagaacccagtatgtagtagcatgaaaacagtctattttcagcctctcttttctgtggtcgataaaactctacctgtacacaggctcttgacttactctggaataaaatgccatttactccccacagtttctcttcctccaggctactctactgctttcttcctatttcttcacttgttacttcgagtttgtcacaagcaattaatttctgtctctgaaagtaaccctgtttaattcaccaaggagccatggctcttcacagcattttagccttacaattagagcatagttatttaatgggtttataatctgcttcctctcaagaagaagaaaaatcaggatgaaaacctcctgcaactattcatggtatttttaagaggctcggggaaagaaaagctaccatagaaatacagattggctaatgggtgtctttaattatatataacacataaatatatataaatatataaacatatatatatatattttttttacaaccgaaacctccagtgtccatttatatcttctctcttttatcccccaaaaaagaatatagaagaaaaagttttgacaattgatatttgatttcaaggttttatttgaccaggtgtggtggctcactcctgtaatcccagcactttgggaggcccagtcaggcagaagacttgatgtcaggagtttgagaccagcctggccaacatggtgaaaccctatctctactaaaaatacaagaattagccagggcgttgtggcacacacccatagtcccagatactcaggaggctgaagcaggagaattgcttgaacccaaggggcggaagttgtagtgaaccgagatcgtgtcactacactccagcctgggcgacagagcaagactccatctgaaaaagaaaaacaaaatttaaattaatttattcaccttcactctgggcttttttccatgtaagtaatgtctcttcattctttttatttaaaatctgctctgtcttcatgtttaggaaaccctccaatgacatatattcctcgttttatgtttatactcactttccacatagagcaacagatttgatttgcaattctacctatttaaattgcaggttactatgaaagttagaccagactagacattctcagactttgcagcatgtaagaataaactgggtgaacattttgcttgcagattctgtgatctcatgtcgaggaaaactggttctatcagtttgggtaggaacaaggatgggtctatttaacagatagtcccaggtgattgtgcagcgagttgcccatggtgcaaatactaagacttgctgtgaggtgatcagtcctaggaagacaaaggatcgtctaacttgtttgcattttcttagttgcatcaatggatgctaaaataactttttttttcccgtaaactgaccacggataatcaatggttccctcatttttatgaaatcatacagagcaaaacagtaaaagcctttcatttcccatttgaaagtaagagtctgggtcaggttctcctgccctgataaacgtgtggcctgcctacctttactacattccacattttctgaatgttatgggatttgtgctttgcatagtgtttcactaaatgataatgtgtcctgttgctttccaaacttttcatgtttcagccttattatcttcagtactgtattttgttttactgacagcccactcatggataacttgcttacaccccccccaccccacccatgtgaccaggtgaactcctattcatccctcaaaaacctgaatagctagtaccatctctggaaagtttttttcttatacatatctattcatccatccttgtgtacctcttttttttttttttttttttttgcctctgtactgtctctatactttaagtacttccatgtctgcacacactcattgaacatgcacgtgctcattctccctcttagactgcaagagatgttggaggggacattagaatattgcctggaacatggtagggacatacatttttagttgaatttatctaaatcgtcatgcagtaaactgttttcagacattgccaaatgtccccctcccccccggggtaaaatcactcccagtgggggacatttgacaatgtctgaaaagagttttggctgtcacagttgggagagtggacactactggggtcccatgtgtagagaccatggggtgatgttaaaagtcctacaatgcacaggacggtccccatagcaaacaatcattgggtccaaactgtcaattgggccaaggtgagaaaccctaattgtattgtgtgctttctgatggaaagcgctacacaacttataagttacattacaagtcatataatttgagatttttgcaaagcagttaattatacacccagagtggtggccagacaatatggcaaagtcaatcttattaaatgagttgatgcttggtgatagattgatcagttgcataattgaagagttattttttttttgtaaaaattttatgtgaggttttgaaggcatatgtgggctatgtgctagaaaaatctcatccactgccttcatttccaaaataaaaacatggtgaattttgtctgatttagttcattcctccctcacagtcttatgtcatgttagaaacaaatccaaggatatttcttccatatgccatattctcacccacttgagtgagaagaatagtacaaaatttttccttgtgtttttttctgttgtgtggggtttttgtttgtttatttgtttgtttgttgttgttgttttgcttttgttgactctagatcctttctgtcaaagtgaagaatgggccaaaagggaaaatacagcaagtatttccatggaacaacctcagggctgtgttggaaatgggagaagtctgccattatggtgatatagttctacattcctcacggaacaacacgggcaaaagtaatttgtgtttatttatcctgccgttattcacaaaatttgaaacacttgtaacatgtaaaacttgagctacaccaattgccgagagatgtatacatccagacttctaatatgcttgaaggtaagcaggtgatgtgtgtgactaagagaggacccatctcagctgtcacaaatcatacagatcagagaaagaatgagagactcaatccttatattaaattcagtgtgctgatgagagaggatacctaatctagtctggtgggtcaaagaagttttgcagaaatgagggatgaagaaacagcatgcagaaaaggtggagtgtagccttgagtagaagttgagtgtgagaaaatagccaagctgttattaaacaataagacatgttcttctgtgagagaaagctcaacatgttttaagggcaaaatcaggcaaaatcatgtcccatatggctggtgcttagcatgagagagaggtaggagagagcaagagggataattatgagatgggagcagcagacagaggactttgttgtggcccagcagatccaataaggtatttataattcatatgaaaagcaatgtggacatttttagcctgggggtggtgagattcgtgttctgttttggaaggataactctggatacatagtgttgtctggtttggaagggaagcaagatggtaccaatgagaaaagagtggatgctctttttagcatcaaccaggcttcctctgatctttgcagccttcttgtagtggtaatggagacacggtagtggtttgggtgcatgtgtatcatgggtgggcagggttggaaatgggtgcgttcaactggtatttaccaaatggaattgacaggacatgctgacacacaggatctcagaggagggaagagagcagagtccaggattaatcttgtgtgctttttgcttggaaagggatagtgaagacatgaattgagacaatggacactggagtggcaatgatcactagtgatatgctggcaaagagatgatgcacttggtcatgatgagttaaaggtgatgaaggcaaccaagttaggatgtcctccagatggtggaaaaagagatttttaaaatgttgtgtggatacaaatgagattctactcagccttaaaacagaaggaaattctgtcatttgcaacagcatgaatgaaactggaggacagaatgttaagtgaaataaaccaggcatagagaaacaaataccacacagtcttacttatatgtgaaatccaaaaaagtaaaactcatagaagtagagaatggaatgatacttaccaggagctgggtgggaggcttaggagatgttggtcaaagcatacaaagttccaattagacgagaagaacaagtttgaaagatctattgtacagcatgctgactatagttaatcataacataatgcatctgtcaaaattgctaaaacagtagatttgtaatgttttcaccacgaatgataggtttttaaagtggtgaatatgctaattagcttcattcaatcatgtaatatatcatgttttatatacatgtgtgtatatctatatctatctatatatagatattaagacctcaaattgtaccctataaatatatacaattattatttgtcaattaaaacaaaataataccttaaaaggctctgaaactgtaacttgaggtttgggaatgagatcaactttccttttcttcatgtaattttttaaatgttttctctagagattgtcatcatcttgggggaagagacctggatttgtcaatttctcataaaagtacttgaacttgaggaagacaactgaaaaatattacccgttatttcctatcatgaaaatagacttgaaacagaaccctgccattcttggctgggcgtggcggttcatgcctataattgcagcactttaggaggccaaggagggcaaatcacttgagctcacaagttcaagaccagcttgggtaacatggtgaaaccttgtttcttacaaacaatacaaaaaattagctgagtgtgatggtgctcacctgtagtcccagctacttggaaggctgaggtgggaggatggcttgaggctgggaagtggaggttgcagtgagctgagatggagctactgtactccagcctgggtgacagagtgagacgttgtctcaaaaacaaaacaaaacattctaccattctttacatccttctagagcaattgattgctcagcactaggattagacaagataactttgtggtcatatttgatcaagatgagcagtatttcttcagtgtaaggcatttctgcattatttgattggccctaactatttagcaattatgtctttcatttagcctgtattcattgcgctgtatgttcttaggaaaatgtgtgttgtttgcatattctttccaaacaaggtttgaatattttaagacaggggagttttgtcctattactttattaactcttatatgagtaggctaattttccaaaaactgggtactgtatacagttggactgcaaataataatagcaatcattattattattattattattatatttctggaaagatattttgagtgcttaggggggaaaattatgctggcatgcagctgcattagtcttagtacctaaaaagggaaaaagatgcttcaattattcatttcaaatactcttatgggatgaagaagacaggagatctgggttcaaacagcagcacacctgacaatttggacctggattattatttgtgtggcatgagactgtcccatgcactgtgagaggtttatcagccttcgtgctctccacccactagaagccaatagcaaccctcactctgagccttgccaaggaaaatcgtctcaagattaaagttaaagatgatgaaggcatccaggttaggatgtgctctaggtggtataaaaggagattagaatgacatatacatacacaataggatttcattcagccttaaaacagaaggaaattctgtcatttgtaaaagtatggataaagctggaggagattatgctaagtgaaacaacccaggagtagagagacaaataccacataatctcacttacatgtggaatctaaaaaagtcaaactcatagaagtagagagtagtgaccaggggggattgccagatttagcaaatagggcaagttaattttgatttgcagaaaaaaatgagtaattatttagtgtaagtatgtcccttgcaatattttgtctggaaagcctgcctggtgtgtaaacatcaccttcagtgtgctcttcttatttctgtcttcttaaatttacaaatacctcaggatctcaggctttgcaaggagacatggcattttacattaggagagtactcaatgctgttctacctgtatatttttaggtaaaatcacaaattcagaacgatctatctcaggggcccacattgtccccatttattgttaattgcatattttccaccttcctccatctacgaaactcagacagtgttaaacactgacgtgtgctaaatgcatctattacttgagtaggattagaattctattgcaaatttctcaatgcccctttagaattcctcttgtgggaaagaactgaaagttctaattatatttcatgggcttgatgaatctctcgtctgtaacagtttttcctccaggttatttctgcttggaaatcttaagttggtaaaaaaataaagtgtactcttctgcctgaggaactgagtggcctttatcttccagcctgctggtcctaatctaattacctggtgtgaagagttatttttggcagtgagactagactgcactggcaatgggtaatgcctcctaacacaacagccagcagacccacaaaattaaaaggaggcatttcataggttatttctggcaagttttagagctgatgaaagcctcaagtagcttttactcagagattaatgcataaaatagatgcataaaagttgcaatgggtttataaactaagtacacggatctgtgtgttccttttaaaaaaaattgggtctacctctattccctcagactctgaacatggaaagaactcaataaatgctaatcgctaaagggaggttaaaatagagtgtctccaccttaaccagaagcttatacttttctactggtgaatcatgccactcttagcctttttcttgttttctttctataaaataaattgtcctcatctgtgatagtgataatggtaatgatggtgatggtggggacgctgatgatggtgatgatgatggtgatggtgatgatggcaatgatggttatggtaatgatggtaataatgatagcaatgatggtgataacagtgatgataatggtgatgatggtaataatgttgatgatggtggtgatgatgatgttggtgatgatggggatgatgatcgtgatgacggtgataatgataatgatgatggtgatggcgatgatgatgatggtgatgatagtgatggtgttggtgatgatggtggtaatgatgataaagatgatgacgatgattttatctctgttctacttatttattttaaattttaacaagcttttagtaagtgttcttcactaagattgtgatcagcttaaatcactccaagaacaagtctaaaatctttttaagaaaacaagacgtcacatacacaaaaagatgagcaacactgtgagtaacaagtaattgagaaacagccttgaggctaatggaaatgcactgtaagtttcctgtatctgggctctcccatatgtgtctctactaactcacattatactctagtactctagtttcagtattttatctctcctttgtaacacattcttttttgttttttgttttttttcagagggaattttgctctgttgcccaggcagtggcacaaccttggctcactgcaacttcctcctcccgggttcaagtgattctcctgcctcagtctcctgagtagctgggattacagctgttgcaccaccacaccgagctaatttttttttttttcagtagagacgggggtttcactatgttggccaggctggtctcaaactcctgacctcaagtgatccaccagcctcggcctctcaaagtgttgggattacaggcgtgagccaccgtgcccagcctgtaacacattctttcatgaggcttattcatccctgatgggaaaccactctcctttctctagcaaataatgactacctgtaatgactaccctctagctgtaatgactttgccccttcctcacctttatttaaaacctgtctgtctttcaaaaatgcctcttcgacatctgcgtcctctgatttctccaacccacattgatctcctttcccttaggacacactattattggggtctaatttgtgatggaattacaaactaatttaccttgctactcagcaattccatgaacatatgcgctgctttaaccatctaacataacacagacaaatgggcaacaggtttggttgaccagaaaaatcagaaacagaaaaaaacctgtgtgtttatacttgtaacttttaatcaatagacgtaaacaattttttaaaaatcagcctcataacgaaatttagggtataatacagcagaaatgaatgaaaaccaacaatgaagcaattcctcccctgctcccaccaaatctgcacccaccaaatcaaagctattagcaacatattgataaatgtcaatactttgatcactctatatgatcgattgcctttctgaaggcttacttttcctttactatattaaaaaattgtttttcaggcttcaaaaaattcaattatacttaaaaattctaataacccttctagtagtagcgtattcatattttaattttttaaaatattgttctaagtaaataatgtaaaaagaggagaaaacaaaagaaaagggagagtaacagcacaaagtcatcagtatttacctctcagtgttgactggggcacaattatctcgtttttattcagctaaaaaagaaaaaaaatgttagttattttcttttcacttttattgtgtgatccacagcacatagtcaacactctttggacatctgcccactctgtttccagcgctgggcaaacacttgagccactaacctggagcagaggacacctctgccctggaatgcagcaggcaacaggatccctgcatggagagatgggcactgtttgaaagttacttggcttaataagcgattgggtagtaaatgccagtcaaggtgacatctgataccaagttttgaagaagagagagaagttgccccagtgtacatgaggcaaaggtattttctacttctgggagggaggggtgaaaggagacagtagagaaggaaactggataagagaagaatcaaaggaagatgaacatcggtcgctgttgtgtgggtgtgtggtttgtatgaaagaaaaccctacatggatgagatattgggattttgagaagagacatttgtaaaatgcagtgttatttacttatttaatattttctacctttattcgggattcaggggagtacatgttcagatttgttacatgggtatattgtgtgatgctgaggtttgaggtacaatttatcccatcactcaggtagtaagcatagtacccaatagttagtttgtaacctttgtcacctttccttcttaccctttctagtagtcaccagcgtcaattgttgccatctttatgtccgtgagtacgccatgtttagctcctacttaaaagtgagaacatacagtatttgattttctattcctgtgttaatgcttttaaaatagtggcctccacctgcattcatgttgctgcaaaggaaatgattttgttcttttttatggctgtgtagtattccatggtatatatgtaccagatttgcttatgaaatccattattgatgggggatctaggttgatttcatattttggctattgtgaatagtgccacaatgaacatgggagtgcagatctctctttgacgtactggtttcatttggtttgttttaagacacagtaaagagtttgtgaattggatctacttctggtgatttgggtgacacaaatgctactgttgctgatctttttgttttggagccaatttcagaatttgccagatccttgtaacagatgtgattcaattttacaaagcctagttcaatgaatagaatcattaagatgttactcctaaaagaggtaagtgataccttacgtcagctctatgttggtcctctgtttaaggatggccagccctaaaaggttgagcaaccacttgcctagataatttgtaataggtcctcagaaaccccacttgccttccggttttgtcgatagctatgtaatatatcttctcctcattcaagggaatcactggcctgtccactccatcctgtcacctctgatgatctgcaaacttcagacctccagggactttggagccagtcacaggtaacaaactccattctcagcactttgtttgattattaagaaacaaaacaataacaacaataacaaaacaaggactctcagctgaattttagataaacaatgaacacattttttaaagtatcagtatatcccagatattgcatgggacatgcttacactaagaaaaaaaccaatcgtgaatctgaaattcaaatgtaacagctcatcttgcgtttcaggtactaactcttcctaatcatcagtcccaggggggacctattgccaggtcaacccatctgaaagccctggcagcagatacaactcggccacatttatcccaggagtgtatcttggtcctacaaccaagcaagtccactatgtttagacatgccatggggaacgctggttgcaaagatcacttagcgggaggagagtgattaaggggttatttgcttacaactataacctgtatctgtattatattaccagctcacctaacaagcttcaggaatttgtgtaataaggctcaaaacatcacatataccacacaaacatatacacctactatgtgcccacaaaaattaaaaaggaaaaaaactaatgagaaacattagctcattggaagatttgagtgtgaacagacacacacagacacacactgcacaccaggattttggcagttattttcttccccccaaaaagctataattttctcaattcaactggaaacaaatgtgttctttgatggagccctaactggcactagaaaaaagcagcttatcttggtatactaacaaattgactggtaggaattatttgagtgtactgttctttatgtatataagcagctgcctacaattaaatttagatcataaaagcatttataattagttatttaaagttgtatttctttttactttactttcattgtctatttttcccctgggaaaaaggaaaatgatgttttaggtgtctaagtagtataatacatttgttcctggtcgcagttgctttaaagatggaaaagcacaaatttgaagtttctcgaattgcaccactttgtttatatagcttcatgctagatggatgcctggattcaactggatctgagcggcagtgagcctttaaaatactaggtttgaagaatttgatgacttactgaaatgttgacatgtactcgtaaatcaagatttattatgaattcctattccctcagtaaaaacaacaacaaggaaggaaatttggcttgtatttattgctcagtaatagttgttatatccattaaaataatgctgcaaagcactggtctatgcctctggaggtcttctgcagagcagcatctttaaattgtcattttggtggcattattaaagtcagatataatcacaggatggagtgcatggttcatttttccatgtcgtaatcacatttttcgcataacatgataccacaaatagacattttcttaccagtagatcagaactggtggcacttttgctcactaggggaaacttagaaaggttttgtaagtcattctcacattgctggttgagaagcactattcaggtctgttacgtaggtaaattgtgggtcacgggggtttggtgtacagattatttcatcatccgggtgataagcgtggtatccaataggtaattttttaattctctccctcctcccacccttcaccctcaagtagacccttctgtctgttgttcccttctttgtgtccacgtgtgctcaatgtttcgatcccacttataagtgagaacatgcagcctttggatttctgttcctgcattcattttctaaggattatggcctccagctgcgttcatgttgttgcaaagatatgatctcattcttcttaaggctatgtagtattccatcttgtatagacacctcattttttaaaattcaatctaccattgatgggcacctaggttgattccacgtctttgctattgtgaattgtgctgcggtgaacatgtgagtgcatgtgtctgtttggtagaaggacttattttcctttgggtctatatccagtaatgggatagctgggtcaaatagtctttctgttttaagttctttgagaaatcaccaaactgctttccaaagcagatgaactaatttacattcctactggcagtgtacaagcattctcttttatccacaacctcaccaacatctgtttttttttgactttttaataatagccattcaaaaagcactattctggataattgatttcatttaggcaaaaatctctttatataggataaaattaaaactttatctgtttaccacattgtgtctctatccatctatattaatctatagctatctatatttatatctatgtatgtatatatagatacagaaatttatgtattttaagtatatatcacataataaataaaatattaattaaatcaattttattaatgtacaatacaaattcatataatatatgtatttttaagcattttttaaatttctaagacttttcttgatatcccccaaaatatcaatgacagagtggtaagtccaaaaattttaaagacacatgtccctcaaaatagtataaacttttttttcctctcctgtaaaaaccactattgtgaacattctattaatcatccctagttgtctaatgagtaaaggagttacccaccattttttctgcacctcctgcagtgctcttcggccactgcacggactccctcacttctaagggggtcaagtgagggctgccctgcttggctgcatgcattcttcacttcacacatggtagacaaatccatcgggacaatccagaccctgctgggatcaccaaatcatgtcatgagtctgcatccacctggctaactccctacaacaaagcagagtcaataatcagtagtgctgcctccaagaaaccctgctgtcctgaaattctaggtgtccttgcactatggggacttctgggagtcctacttaggtttgatcgtttgtaactttcctgtacatatcttccataaatccccatcatctgaaatactctgtctgcatccccatccttgccatctaaaattaccaatatgcattatttacaaataccgttttctaggaggattggacccattgatctgcatccccatccttgccatctaaaattaccaaaatgcattatttacaaataccgttttctaggaggtttggacccatcgatgccaacgagtagcacagttgagatgaagcattgatgtcatgaatcttgaagaattttccgcaaacatgttctttagactagtcataaaacagcaggatattctgtccatgtttattatttttgtgtctatactgggacaggtgatgattaaagcatcattcactgaaattgaaaacaaaaattggaaagaaattcaaagagatgattataattgataaatcatgactgagactgacaaattaaaagcacagattaccagagtgaataataaaaagaaatgacactgaaagggaaataagagaatattaccactaaatttatgactatacatttgatgactaagaggaaatggaaaaattcctggaaaagcgtaacactgtgaaaccagcacaagaagcaatagaaaatttgggcagtactacatctagttttaaaaaaagaatgaaaatttcaattaaatatgagtttcaatactaatatgggtctcaaaaatttaacatgggtttcaacatttcccataaatgaaacttcaggtcctgactgttttccgagtaaattctaccaaatatttactatggaaacaatgctaaatctatacaaactttatgttacaggattacggaataaagagaatgtatgtaactcctttaatgtggttaacataatcctaatacttaaactttactacattatccctttccaccccattagacagtatctttcatcatatagacaccaaaaatctttataaaatttagccatatattagtccacaaagagtctatatttcaaactataattgcttaaactgaattctgtgacaaagtataaaaggactatgaatataggaaaattgtggaccacatgaatttgtttattttcaaatcagcaaattaattttaagctgagacatcaaaactttaatctcaaaccatctggataaaatatataaaatattacatgtctaaaactgtagtataaataaagcccaagagacatttccaaatgtagacacctttaataataaacacatattaaactaataaattatactcaatttgtttaaaagaaaacaaaatattattaaagagacaggaagaaaataatttgtaaatataataacattctgatcaattgaggggctggttctgttgggaaacaaaaccagtgatatgtaaatagctaatctcctcctggagagaacaaagaaaataatcagttcaaaaatttataaaagacaaaaaggaagcaaacagagaaactaaattcagcacaattaatagtttgagaccagcctggacaacatggcaaaaccccatctgtacaaaaagtactaaaagtagctgtgtgcatgactataagtaccaactactcagggggttgaggtagaagaattgcttgagcccagaaggtcaatgctgcagtgagccatgattgcgccactgcaccctgggcaacagagcgagatcctctctcaaactagagtagaaacagatttttttcctaataataaataaataaatgtaggtgtaccgattgcttaatgaattaatgagtttctcctggaagagtgtgtcatggaatctagatttggaaattccgtgttagagcagcacttttctaccatgctttgagcatttcagtcctctgggattctgcttagtgcaggttccaattctctgtgtctggggttgtgtctttgattcttcatttctaacaagctccaagctgagactgatgctacccattcatggaccacccttggagtagaaagtagtcagagcataaagttaagaggcagggagtatggagaaatgaggctttcacagcttggtctagcgtgttaattagtttttatgacatcctgcaggcgatggtaagccactgaagagctggaaggagttaagtgatcatgcatgttttcaggagtgtcttctgaatagagggtaggtttgatgtcattaacctaagggcagagactcacgtagacaactttgtaataggcaagccaggagaagacaggggcatgaacaaaacaagtaaaccagaggagagtggtgagattttcaggaaatatttagcagtttcaatcaccagaatatggccattgattgggggaggtgatggatgtgggaggagaagcttcaggcagcagttcccaacctttttggcaccagggactggtttagtggaagacaatttttccacggactggtggtggggaggatggttccgggatgattcaagcacatgccatttattgtgcactttatttctattattattacatcataatatataataattgtacaactcaaactcagcatcgtgtgaaatcagtgggagccctgagcttgtttacctgcaactagatggtcccatctggggtaatgggagacagtaacagatcaccaggcattagattctcataaagagcacacagtctagatccctcacacgctcagttcacaatagggtttgtgctcccatgagaatctaatgccactgctgatctgacaggaggcagagctcaggtggtaatgcgagtgatgggaagaggctgtaaatacagatgaagcttcgctcgctagcctgtcgctcacctcctgctatgtggcacggttcctaacaggacacagaccagtaccattccatggcccggggtttgaggacccctggcttaaagggaaaagaagataaggttgataatcagattttccagtgtgagtgattggtacagcacatgaaaggaagaaatgcaggtggacgaaccacttaggcagagacatgctgagtgtgttgtaaccttgctgactttgagtgtctgtgtatatccaggaaggcatcacaggtatgtggttggagatatgagagtgaagctagtggaagtgcatccatgatgtagatatgaaagaggcacagagctggtaagtgaaacaaaaagtgtgcatgctgtgacagcctagggaacaaggtaaagtgaagaaatcagtggaccccatgacacagaaaacaccagcaagtaaagttagataaatggagaaaatcaacagacgcaatgacagaaaacaccagcttgggtttgataaatggagaagaaacacttgaaaaaagtggaggggagaagttcaaggaaaacagacacgcatcatgtaaccatgggagagtttgctagacatggtgaacctctagctccaactgggattgtgaaatggattctacattgtaacgagatgccttatgtgataggaataacaggttgcagtgtaagaaatcctaaaatgggaacggttccagggagaggctagcagggcttctgtggggtttgaaggaatggttctagagtggaaggatcattgaggaacgtgagagaggaagctacccagacagaaacagtcaggtcgaagagcaatggtaagtggactttttttcttgtatcccagtctgcacaatgttagattttcttaactattcatccttttgggtgtgtgtacagagactgatgagtgcagcacaaggcaggactggggctctgcacacatggaagagagtggagaatagtgaatccagctggctggtgagagaattgctcagatattcaatcaagggcatattagtctgttattacactgctaataaagacatactcaagactggttaatttataaaggaaagaggcttaatggactcacagttccacatggctggggaaacctcacagtcatggcagaaggtgaaggagcaaagtcatgtcttccatggcagcaggcaagagagtgtgtgcaggggaactcccctttataaaactatcaggtctcgtgagacatattcactgtcacaagaacagcattggaaagacccacattcatgtttcaattacctcccacccggtccctcccattacacgtggaaattatgggagctacaattcgagatttgggtggggacacagacaaaccacatcaaagtgttagaacctttctggaaaacagtatgaggatttctcaaagaactaaaaatagaaccagagtttgatccagcaattccactactagctatatgtatccaaaggaaaagaaatcattctatcaaggagacacctgcacttgtgtgtttatcatagcactattcacaattgcaacgatgtggaatcaacgtaagtgtccatcaacagaggattgtataaagaaaacgtggtgcatatacactatggaatactacttagccataaaaagaatgaaattatgtcttttgcagcaacatgggtgaacctgcaggccattatcctaagtgaattaactcagaagcagaaaataaaataccacatgctctcacttataagtgggaactaaaaaatgtgtatgcttggacatatagatggaaacaatagacactggggactccaaaaaaggggagggtggcaggggagaaagtgttgaaaaatgacctacgtgtacaatgttcactatatgaatgatgggttcactaaaacctagacttcaccactatgcaatatatgcatgtaaaaaacctgcacttgtacccccctaaatatattagaaataaaacaatattttaaaaaaagccattaaaaaaaggtttggaagaaaacccttcaaaaggctgataacctggacaaaatagaaggatgtttctgccctaccactggataaactaagtgggaaactctaacagaaagatgaagttcttcccatcgctagacaataagtgagaaaatctaagagaaagatgaactttttctaccaagtgtattggaaggcagatgtggttgacccttaaacaacgcaagtttgattttgtggattttattttggctctgccagtcccgagacagcaagaccaacctctcctctttgtcgtcctcgtcagcctactcaacctgaagacgataaggatgaagacctttatgatgatcgacttccagttaatgaatagtaaatatattttctcttccttaggatttttttaataacatttttttttctctagcatactttattgtaataatacaatattcaatattcattagatcctgatacagtggaacataggaagagatggatggtatatttggcaagtggatggtggaaggggagtagacgtggggttatcaggattgtatctaaagatgtttcttctcgtgctgttgaggctgaagaggcaggggaaatagaacggggcacagttttaattttcagatttagtataaagatctgatcatttctacacacaaagcgtcatgtttctccatggctaaaagttatatttatacccctagccaagacacaatctccaataatatttctttccatttttatccctggattcaccttttaaatttaataccccgaggaactcatccttcaccagggaagcatctcatgacatgcagttgacagtgtacttcgagcctcttgggaacatcatttgaggcagtcttcctgagtgtgctccagcaaaataagtacctctctcccagatgctgttgtggactcagacaggaataaattgcagcccttcgtacaatctacagtgagtcttgctctcatgcagaagaacctgagtgatatagcttggatctttgtccctgccccaatctcatgttaatttgtaatccccagtattggaggggggcctggtgggaggagactagatcataagggcgaatttcccatgaatggcttagcaccatcctcttgttgctgtcctcatgatagtgagtgagatttgtgagacctgattgtttaaaagcatgtggcaccctccaactctctctctctctttctctctctcgctctctttctttctcctaacttctgccatgtgaagggcctgctcccccttctccttgcaccataattataagcttcttgagtcctctccagaagcagaggttgacaccatgcttcctatacagcctgcagaactgtgagccaattaaacctcttttctttataaattacccagtctcaagcatttttttatagtaatgcaagaatgagctaatacactgagtttataaagaacagaatgtgtttgtattggtgaaatgcagacacaagtcaggggaccgtcttttccatgggtgctgtatattcttgggaagaaggaggttggtaggctttgtttgtgttggaccaaggagtacagatagggcgtggtggtatccaggcatctgtgttatcatctatgtattgctggtattcatataactgttgttatttccatttgttccaagaattggtccatgcaggtccacctgggctgacctttattctcgaccactaagcttcttaaatcttcctttcccttaggtgagtctgtgatgtctgtgggaatatgggatcatcttgtgtcagatgttccatgcacaaacgtcctggcactcctcaaatataacagccaacaattttaaccacattggatctacttgtttttgttttgttttgttttgttttgttttgatgccataaatccatttggaagtttggcctcagacaaaccctcaggcaagtttggaacataggagggcatagagagataaccttgagttgtttttttttttttaggaagcacagcctcagccctttaatatcagttctgctcttttcccaaaaggtggtggtgatgcatgagttaaaccacacaccctttttatttgaagaaatggagatagaatatgtagcttactgtctgtaaaagaacatgagagattgaagtaatacaaaaaaatctaaaagacaaagcttaggaattcttaaatagaatctgaacacatttgtatcctgacagctaagttcagaacctgtgaaatagttcttgaatgtatgaattaatgaaagaaaattcaatttttttaaaggatggaagtgcttggttggagaactaaatagttgagtgaacacagtacacagacttgagtgaacacaacacacagacttactgagatgtctgcaccgttgctattttctgcttgctgcaggtgtcccaggggatgcagaacatggttacaagggaaaaggagttggagactgtcaattgccttcagagtaagaggaaagggaagaagaaagcgcagagcaggaggaggaaggatggggcagggctctcatctggctgagtgacatgaattctcagaatgtaaacgaagataacagcatatccttaaagctgcgttcataaccctggctaagattctggacagataaaatgcatgcctgttagccatgcatgatggcatctgcatgtagtctcagctgctagagaggctgaggcaggagaattgtttaagcccaggagttccaggctgcagtgagctgtgattgcaccactgctctccaacctgggtgacagatcaagaccctgtcttaaaaaaaaaaaaagaaagaaagaaagagaaaagaaaagaaagaaagaaaaagaaaaggaaaatggtctggcaatagagtgaaattttgtctcttaaaaaaaaagaaaagaaaaatagaaaaacaaaaacaaaaccactggggactcgaaaagagggagagggtgggagaaagttaagcattgaaaaattatctattgggtacaatgttcattatttgggtgatgggttcactagaagtccaaaccccagcattatgccatatacccatgtaacaaacctgcacatgtatccccgaatttaaagtaaaaataattttgttttaaaagcatgcctacatctatatcctgggatctcaggaatgctcctttaatgacgcattttagctgtcactttgactgggtcatggaatgccaagatccctgattagacattattttttagtgtgtctgtaagggtgtttccagaagagattagtatttgaatccatagattaaagcagatgaaacctccacaatgtgggcagacatcatttaatcccctgaaagccagaagagataaaaaaggtggaggaaggctgactctccctctttcttcctcactgctgagctgggacatttatcttctgccctgagtgctcccagctctcaggtcttcagacttggactggaatctacaccattgtctctccagctctcagaccttcttcaatgacaccactggcttttttgggtctccagcttgcagacagcacattgtgggacttctcagcttccataattgcatgagccaatacttaaactaaatctctttctatccatctgttgttctactattctatcattatgtcattctatctgtcaattgttctagccatccacagttctattcatctgcccatctacctctccacccttgcaccccactgaagcctccaggtcccttttcctgcaaaattatatctcctctggatgtctggtaatttccttgtgctgttgtttagtttggctgttgactttcaaatttctcttgtctcttttagaaatggcgaccattaaatgaataaagtgtcttatttcaaagagaacaggtggacatttgtggattctgcataatgtatgaggaaggaggtcaggcatgagacttgtgttctgcaaatgcttctgaggatgtttcttaatgccaccatctgattattcaaggtcaccatattgtcctctgattatatgaagacttattggctgcaaatgtaatgaagaccaatgccacctgtctattgaccctgtaatttctcctttcattgaattactgaaatttatttatcaatcaatttgccttttataggcttttataattataaggagccttgaagagtaaatggtgtggtgtccaaatcacattagctggtcactaagggaaatactaatataaacacaaatttttcttcataatccatataagtttgattaattgataattcccttcagctttatcatacactaaggtatctacgtagcagaaaaatgaggaaaaaacccgaattgctacgagattatgcttcagattttttaaaaaatcatttgtaattttacattattacatgaggaaattaatggcttaagtgggataaattagttaccatgtttgtagctgttttagacctagatctttttttttccataagaacactctgccttataattgatttactgagttttagtgagatattgctcacatatcctaaagttccctcttttaatgtgtccaatttagtggttctttgtatgttcacagagtcatgcaaccatcacctctaattccagaacatttttatcaccccaaaagggaaacctcatatttgttaaacatttacttcccattacctctgtctccaatccctggcaaccactaatctatattctgtctatatatttacctagtcttggcatgtcatgtaaatggaatcatataacatgtggcattgcctgtctggtttctttcattgagcatgatgttttcaacgtataaccgtgttgtagtctatgtcagaatttcatttctttttatggccaaatattactcctctgtatgggttggccactcctttgaatagataaacacgcgaatgtttgtgtattcatccattgatggacatgcgtgtggtttacaattgtttggcgattatgaatactgctgtatgcacatttgtataccagttattgtgtggccctgtacgttcatttattttgagtatatacataggagtggaatagatggagtcaaagagtcactctacatttaacattttgaggaactgccagactgttttccaaaatggctgtgtctttttatagtagtgtgggaaagttccatcagtagtgtaggaaggttctatcagtagtgtatgaaggctcccaacagtagtgcaggaaagttccatctttttctctaccctttccaacacttgttattatgtctctttttcatttttaattctagctacatcacacacattgaccccataaaaatactaatttcaaaaaaacaaattgaagtttctacttttaattgcaaaagattatttctgctcaacctcagtaatcatcagggaaatccaaattaaaaccgcaatgagattttatcttaccccactcagaaaggctattattaaaaagatcaaaaataacagatgttgatgaggatacagagaaaagggaatgcttaaatactgttggttaatacaacctttatggaaatcaatatgaagatttctcaaatgactaaaattagaactaccatttgatccagcaatttcactactggatatgtactcaagggaaaataagtcatcatattaaaaataaacctatactcacatgtttgtggcaatcctattcacaatagcaaaggtagggaatcaacttaagtgtccatcaatagtaggctggaaaaagaaaatgtggtacatatacaccacagaatactattagccataaaaaagaatgaaattatttcttttgcagcaacatggatgaaactggaggtaactatcttaagtgaaacaaaccaggcacagaaagtcaaatactacatattctcactcacaagtgggtgctaaataatgtgtacaaatggacatagagagtagaatgacaaacaatagagatgcgaatgggtgagtgggtgggagggaggagtgaatgatgagacattagttaatgggtacaatgtatgttgattagatgatagataacctaaaagtcctgttttgaccactgtgcaatctatgcatgtaacaaaaggcacctctacctcataaatttgtacaaaaaaagattgtttcattgacagaagaatgcactaccatatttttttaaactagattcttcctatacattttaaaatgctgcttgatatacttaattttttaaaatgatcaccttagatgcaagctagactcataactcaatacgcaatattttgggtatgctgatttacagaagtgaaaacgattccagcaataactaaccttttgcaagtgaggacatccatccagcagggtctctggtatccccatatctctgagctgcttccattacaacaacactcacagagggcttcagtcatgtctcaaatacatgctagagtttccctatcaggatggccagccctctgctgtggtcgtgaccttgatcaccctctacgatctcagcatcttctatcataaagttgactccacctcaatgacgaagtatctctcctctttctcggtttgtcccaccacatcttcatccctattacatctttcctctacttaaattggggtattgttcccttctcattggtcttatgctattttaggagactgctaattaagtattctttacccagagggctggaggagggaatcatctccaggttaggtcaaaggatacttaaattgcaacaatcagagggtcaaatgtagatttgccttcccacagaaaaccaaatggtgcatgagatggaagccagggacctttaatatctgttaaccgtagacatgcgggtgccttggtgagtgagtcttccccatggatgcaaacagccctgtttctgcgtgactcaaaggttctctcccctcattcagtatcattatacagactattatttggagactgctctctaggtcaggcatctaactgcccactgaggaaagagtgagaataaacagtctttcctctccaactgttttagtttgtgaaaaggcaatccactgttataaaggcgagatgttctgcaattcttctcgcacaatgcacctttctatgatacagtgagctccaatgcaattgaattcacagcggcactcctaactcaaaccggggtcacagatatcctcctgggagatggaaaggctaagaggacctacgaattctagcaggagtcacctgggggaagaagttcaccggtgacgtccaaacagaatacggcttgttgagaggaggggaaaaccttgttgtaggaagcagcattcaaccctcaacagatggtgaccagttaagtcagttggagcacaatggttaccacactttcatgtctgctcttttgtaatttatggtgcaaatttgctttccttccaggagtctggtatttaggaaggtggtaagcagagggtgcctatgtgaccagccgctaataaaatctttggttgtggagtccctgatgggtagaaacactctttgggcatgactgtttttgttactgttactcctaagaagcctgtgcttggatttcttcaaactatgacagtgtctttttcccttaatgatgtggctgagtatcattactgtgttgctgtaatgagtcttaactctaactacttctcacaaatttttgagcatgggttggtcttgggcacaccccaaacaaataaaatacaactttccacaaattgaacacagctttccacaaattgaatataactttccacaaattgaacacaacttttgcttttcacaacatcctgtgttgtgaaacaagacgccaagagttttctgcatgcactcacctgcaatggagtgattttcatgtttgcccatcccccccagtaaatataaaatgttgtaacatctttataggcaggaagtatttctcactcatctttgttttttttccttttattttttaattgacataataattgaacatatttatgggatacacagtggtgttgcaatacatataatgtaaagtgatcagattggggtaattagcatatccatcatcctgaatatttatcatttcttggtgttggaaacattcaatattctccttctagctgaataaaaacatatatattgttaactgtagacatcctacagtggtatagaccaccagaacgtattcctcttatctggctgtaattttgtatcctttaactaatctctccctatctcctccttcccaccacccttcccaggctgtagtatcctctggtctagtttttaattctatgagatcaacttttcttttaacttttacattaaattcaaaagtacaagtgcaggtgatatggttaggctttgtgtccccacccaaatctcatcttgaattaaaattcccataatccctatgtatcaagggagagaccaggtagaggtgatttgatcatgggagtggtttcccccatgctgtgctcatgacagtgagtgagttctcatgagatctgatggttttgtaaggtgcttttcccccttcgttcctcacactctctcacctgccaccaggtaagacatgcctcttccccttctgccatgattgtgacttttatgaggcctccccagccatgcagaactgtgagtcgattaaacatcttttctttataaatgaccaagtctcgagttgtatctttacagcaatgtgaaagcagactaatacaacacatttattacataggtaaaattatgtcatcaagattcgttgtacagattatttcattacccaagcattaaccctagtacccaattcatatattttctgctcctctccctcctcccaccctccacccttttgtgggtcccagtgtctgttgtttacttctttgggtccatgtgttctcataatttagcccccacttataagtgaggacatgcggtatttgttttatttggttttctgttactgcattagttcggcaaagacaatggcctccagctccatccatgtccctgcaaaggacatgatctcattcttttttatggctgtgtagtattccatggtctcactcagcttcgtttccttgcttcctagtacaggatgcagtgcttggcttatggtaggccctccatggcttatggtaggccctccgtgaatatttaccaaacaaatgcagaatgaagggattgccaatcattcagcagttttccttcatcctttgaaaataactattattattactattttacatatttaatgggtacaagtgcaggtttctgacatgcatacattgcatactggtgaagtctgggctgttagtgaacccatctcctaaacagtgaatattatacccactaggtaatgtttcaaccctcactccccttccactcttcccatctttggattcaccagtttctgttattccactctctatgtccatgtggactcattgtttagctccacatataagtgagaatatgtggtatttgactttctgtttctgagttattttacccagaagaacggcctctagttccatttattttgcaaaagacatgatttcattctcttgtatggccaagtagttttctgcagtgtgtatgtaccacgttttctttatccagccctctgttgatgggcacttcggttgattccatatctttgcatttgtgaatagtactgcaataaacatgcaagtgcagttgtctttttgatataatgatttatcttcctttggatacataccaagaagttcaccactttggttattgaagacagtttctaaggacagatcattaatctattgtcaccaatcaggggagaccgtgtcctatataattgcaacttcaaagttagtaaaggccaatttttatttgagggaaaaaaatcttacttccaggaatgtattataaaatgccaggcaggtttatcgcagctgggatcactgtcactacagaactgtctggggagtccatgttctcttataaatcagcctggctcttcatatatgtttgggctgacttgtcatttacctttcttgggaagaagcaagaaaaagatgaacctcaccccaacttacttgtgtcctctgataaatatagccctggtgagatttcgtggaaagttttcacacagaaaatgtgaaactttatcttgaaaatagcagataagtcaactatttaatgatgaaagaacgcatatacactggttgactggccagggaatgtggcttttactaatgaagaagtaacaaggaaagcctatgaaattaaaaaccaaaacagttttctgtcattgttttgtttataagagatcaattttatactttcttttaatatatctgttctttttcttttttcttttctttccatttttttttttccttgatacagggtattgctttgtcacccaggctggagagcaatgatgtgatcatagctctctgcagcctcaacttcctgggctcaactgatcttcccacctcagcctcctgagtagttggaaccagaggcacacgccaccacaccaggctattttattattattattatttgtagagatgggttctttctatgttgcccaggctggtctcaaactcctgagctcaagtaatttttccatctcagcctcccaagttcttggaatcacaggcacacaccactgtgcccagctattttaaaaaattgtttgtagggacagggtcttgctctattgcccaggctagtctcaaaccccttggctcaagcaatcctcccacctcagcctcccaaagtcctgggattaggggcatgagccacagcacccagccaacatttctattttttctactaaaatgctcttcgtgcagaatgtttttagcaatgatagctcatatcctccaagaacagagcatacgaagtctacagatgagatcagaaatacgccgttttttgatatctcctatctcctgtgttcacaaacttcacgaggctttttaagacagttttacaaaccccacttatgggaaggttggtgtgctcacatatctccaaatccacctccagatttgatgatctactagaataactcaaaagactgagcagataatcatactctaagctatgatttatgtaagcaaaatatagcaagaaaaattagcaaaaggaaatagcaaatgaggtgaatgccacaggaaaccaggtgcaagcttccaaggaaattctctctcactggagtcacagaggatgtgattaattcctccagtgatgaattttgacaaagcgtttgaaatgctctctaccagggaatgcccttggagactcagtacccaggatttttatgggggggatcttcacaaagacatctaccgaaatttcagccatctggaaagaaagcaggtgttctccccaaattacatttttggggtgtagtgtagacatcatgagccatgcttatcagttagggtagcgggaagttccctaagtccaagttcttaaatggcagtcttgggccaacctaataagtatgactttctcaggatagtctttctcaggatagagctcaggtccttagctcaactctttttagtaggctttttattttttattttgttttatagcacagtatgaaggaatatccaggttcataggaagttttcaaccaatgtctgcaatgatgtctctatgacaaaagatggttttcagagaaaatcccttatatattgctaaatagaactaatctcccccactattgggtatattaaccatggcagcatattcttcttatttttaagctggatatataaactcgtttttcttttgtatttgtataaatttaaggggtccaagtgcacttttattacatctgtatattgcctagtggtgaactcttggcttttagtgtatccatcacctgaataatgtacatcatacccaataagtaatttctcatcgcttatccctccctgaccctcccacccttctgagtctccagtgtctattattccactctctatatccaagtgtacacattatttacctcccacttatgagtaagaacatgcagtatttgactttctgtttctgagctgtttcacttaaggtaatgtccttcagctccatccatgttgctgcgtatagtagaaaattctaatggcaaccacacctgatgtggaattatctttgtgtgtgtgaaataaaattatataccataatagtcacccttttaaagagcacaactccgtggcttttagtatattcgtaattgtgcaatgtcaccactatccaattgcaaaatacttttataacagcacaaagaagcctcatatctattaaaagttacaacttcaaagttagtaatatggactgggtgcgatggctcgtgcctataatcctgacactttgagaggccaaggtgggcggatggcttgattccaggagtttgagacc[139 bp omitted]cggtgaaaccccgtctctaccaaaaatacaaaaaaattagctgggcatggtggcgggagcctgtagtcccagctactcgggaggctgaggcaggagaatggcgtgaagacgggaggcagagct[135 bp omitted]ctgtcgtccagctactcaggaggctgaggtgggaagatcacctgagcccggggaggtggaggctgc[134 bp omitted]ctactttttgactccatgaatttgcctcttctggacatttcttgtaaatagaatcatacaccatgtgtccttctttcactcagcataacttcttcaaagtttatccacatattagtgtgtgtcggtacttcattttttttttgtttttttcaaatgagcaattgggttttcaagtagtgagttcaggggtctaacactggataaagacaggtttttttgtttgtttttgtttcatccaattatttttcttctctattattaataggggaaacagttaacatttaaaattataaatttgccttctgagtaaggcattggctacatcccataactttagtattgccatgttttctagtagtttagtaatgtactatattctaattaatgcttattacaattatgatttcctcttacatccgatatttataccagacagagtttcttattacttgtatttgtttgtctcatacattttttattttgatgtcattctgaattgatgcaccaactataaattagtgataaaatgctgcctggaccacattagcttttatgaatttattaagattctctttctggtgtggtatattaacagcacttgggagcatcctgtggacaaatgaaaaggggacacggaatctgcttgaaaagatatgttctgaagcttagggttgatctctgccacagggctgttctttttgtagtataaagtgatttcccaaagaacttaaaacagaactaccatttgacccagcaatcccattattgggtacatacccaaaggaatataaatcattctaccataaagacacatgcacgcatatgtttatctcagcactattcacaatagcaaagacatggaatcaacctaggtgcccattagtggtagactagataaagaaaatgtggtacgtaggcaacatggaatactgcacagccataaaatagaacgagatcatgtcctttgcagcaacgtggatggagttggaggccattgccctaagtgaactaacacaggaatagaaaaccaaatactatgtgttctcaccgataggtgggagctaaacatttagtacacatggacacaaagaggggaacaatagtcactggggactacttgagggtggagggtgggatgagggtcaaaataaaaatactacctatcgggtactatgcttattacctgggtgatgaaataatctgtacaccaacctaaaataagtttatttaaaaaaaaaaaaaaaaaacaagaaaacaacaacaacagctgtaggcaggtgacctcttagatctctacaggtgactgtcctagacttcagatgaaccctttaatattttgttaatgattgtttcacagagataatttctctttcattatgggtctgtaatgtggagccttatgttgatgaaaagaattatttatggaacattgtcaaagtccaggtgccattgtgaggcgtggattctcagcatccacatggccttcatcagtgtgtactggctgaaggtggcacttcctgtattacagatatagtggtggagagcctcttcccagagacacggggcctggcagactagcaagtcatcttatttccaatgtgcttatggagttcccctcaacagcgccctgtgatagacagcccagagaatctgagctatgttcctgccgtgaacatagttgatcattctctaccactgagtactggggctcccagctcctggcactccatcagtcagcatttgccaagctctcatggtgcaggaaaaaaaagtgttgcatacacaggaaaagtatcaacagaagaggaagatgtggtatgtgctctttagcaatttaatttgattagatgtattttttgctgttacaaagaaagcctgtggctggaataaaagtgtgaagagctgctgagaaccaccaacagtacggcatttaattgccctggatttcaattttctcatttgtaaaatgggaaccagatgagattatctgtgtgaaagacctctttgcttatttattgaacatacgattttgctctgtcgcccaggctagagggcagtggtgcgatcaaagatcactgcagcctccatctcctagctcaagtgatcctcccacctgagcctcccaagttgctggaagtacaggagggcaccaccacacccagctaatttattctattttctgcagagaaggggtctactatgttgccccagctgatcttgtgctcctgggctcaagtggtcctcctgccttgggttcccaaagtactgggattacaggtgcgagccagctcactgggcctgcacttttaaaataatatgagattttgaagggctttaaccttcctctattcttcctcttcactgcctagtataggaataagtgtgtatggttatgaaatcctaagttgtttgccaagtaagataccataagagaagagagaaaaaaagagtcagagacagagagagagagggagggagggagaattatttctctactactattgtcttggatatttgttgacaaggtgacacaaagaactaggtgaaattaagcgtaatgggcactaaacatcaatttggggaaaagaccaattcatagcatcttactcatggtggtattttggaacattaacggctgaatcaccttagtttccattcaacctatactatgaagtaggacttaaaaaattaactggaatttagagtttttatgagtattatgcatgattctaaatacaaccattctaaacaacagaaaacatatgattttatttctttcagtcttaaggagcttaccatacaagtaaatttatggcacttgcttctgcaatatattctggccatgtgagctgaagctgtttttcaaaatgcatgtatacaatttttttattaagggagaatattcttttcttttcttttttttttttttttttttttttttgagacggagtcttgctctgtcacccaggctggagtgcagtggcacaatctcagctcactgcaaggtccgcctcccgggttcatgccattctcctgcctcagcctcccgagtagctgggactacaggcgcccgccaccatgcccagctaattttttgtagtttttagtagagacggggtttcactgtgttagccaggatggtctccagctcctgaccttgtgatctgcccgcctcagcctcccaaagtgctgggattacaagcgtaagccaccatgcctggcccgagaatattcttatacttagatgcaggctcaagatttgccaactacaaatttctatttggatttccttttaggggaagatttagtgtcaaaattaacatctctggagaatgtccagccttccaaatatgattccttgatcaaatactcccattcctgaaaaaccttcctttgatatcaaaatttttaaagaataaaatgttgactaaaccattaaattttaatttaattttgtaagattgttggtttctagaatttaacagcatcatatattttaacaatttaatacattagaaataacagatttaaatgtttaaaagtttagaggcttttttaagagtataactcatagaccataacgttcaacctttcaaagtatacagttcgatggttttttctatgttcagagttttacaaccatcaccactatctaacttcagaatattttcatcatcacacagaaacccagtacccattaagtagttacttcccatacactctccctccagccctgacaaccactaatctgttttctgactcaacaatctttcagctactgtgatagtcactgacaaaaacatttgagttcaaagaagatataatcaaagactggtggcttgctcggggaactgtcttactgctctgcaggtgtttttgccataagtatgtccacttgatcctcaattcattcctgatatggtttggctctgtgtccccacctgaatctcatgtcaaattgtaattcccagtgttgagggagggatctggtgggaggtgattggatcacgggggtgcactttccctttgctggtctcatgataatgagtgagttctcacggaacctgatggttttaaagtatgtagcactttcccctttgctctctctctctctcctgccgccatgtgaagagggtgcttgcttccccttagctttctgccatgattgtaagtttcctgaggcccccagtcatgctttctgttaagcctgtggaactgtgagtcaattaaagttcttttgtttataaattaccccgtctcaggtagttctttatagcactgtgagaacgaactaatacaatttcctttgttgtgcatacatccaacataaagaaccccattccccatgctcagttggggattaaaagcaattgaataactttttccatagacattgtcattcttctcttgtaaattcagggattgaggtcttggtggatgactactgtcatctgtgtatgagctggacataaggttgaaggaagtgactgaaggtaaattacagccttactcaccatcctaaaaatcccagccttccattgtggagcttgagggccctgatacagcattattagtgctctggaaatataacatgactgaccaggagccagcacggatgaaaaaatgcccagttgccccatcaattgctcaaaatctattattcacactacacaaaaacacacagcatatgaggtcataaataagttaattagctttatttagtcaccccacaatgtatacaaatatcaaaacatcatgctgtacacaactaatatatacatttttgtcaaatggtaaatacatttaaatttttaaaatctatttattttaacctattttttaaatatttattcatttgttttttgagacagagtctcactctgtcacccaggctggagtgcaatggcgcgaacttggctcactgcaagctccgcctcctgggttcaagcaattctcccgcctcagcctcccgatacaggcacccaccatcatgcctggctaatttttatatttttgtagagatggggtttcaccatgttggcca[137 bp omitted]tggacttgaactcttggcctcaagtgatcttcccaccttggcctaaatgcaagtgtggtggtgcttgtctatagtcccaggtgtgatttatttcagatcactcactatcttcattatcctgaagtatgaatctacaaggcatgattttatgattctatggattaggatcaagagtgtctttttgaatatttacatagaggggctgaaaaatgaatctcctgtagaatgtcttagtaagaaattgcatttaaaatgtgaagcaaattgaatatgtgaagcatattgaataccaacaaatacatataattatggtccatattgaaatctcaaagaccaatataatttagggcaaaaatagggatactaaacttaataacaaagagaggctattttatccttccaaaataaaaagacatcgctgattaaagaagagccctgtaaagagaactccattaaccattgttctgctcatttatttagtgcaggcaaagacattgttctcaatgtccctggagtggccttagaaagccacagaacacaaaaatacaagtattaataacaacagatcattaatgaatacttgttaacttttacaatacatttgttatacataaaattaataatttgttaccaattaaattaataatatatgaacgcatggataatttaacattaagaacccaggtttgagtcaaccaggaaaagaaaagtggaattccacagtatggtcatgcatcttagtagaataaaagaatctctatgacctacccatctttgcctctttgctagcagaatacctcctctcttaccttgcctgaaacaatgcaaaacagcaaagatactttttttatgacccaaaacattactttatccacctggcaattttgttttcctgttggaattacttttttaaacgaaatcatgaggagctccagttaagaagcaaagtgtgttgtttttcttcctagatggaatgttttgttgtaactcacaggaacatatatgggcagtacaatctttctcaaggtggtttctgaaatgcatcacatctaaacagacactgtattgtctctcctccacataaacaagcctttatcagccatgatgcaaaaaatcaatattttgattatgtgaatttttatactattaaaataataaaaaaaaactttagaagaatttagcagagtttatttgagcaaagagtgattcacgagttgggcagcacttgggagcagaggaggttcagaaagctgtgccaagcagtgtgacaagagaggttttatagaccaaatacagaagcaaagtagaaaaatcatctgatcggccacagctggccatcttctttatttgggcataatgtgatgagacattcaccttatttgagaacaatctgattggttgtatagctgcgattaactgaagctcaactgtttgtaatgaggtgaaaccctaagtttttctttcctacatattacattaaatctctgtttgttatgtagagactccaagtatggaagcatgaccacctcatttaatttaacaagacttacagtccaccattggagtcagaatagtacctttgtaaaagaaatgtgtgtgaatttttcaagagctgtggcttccttcagcatcaaagttattttacactgacatgtgctccatcttcgggatttttgtttttgtttttctgagacagggtcttgcttagtcacccaggctggagtgcagcagtgtgatctcagctcactgcaacctccacttcccaggttcaaacgattctcatgcctcagtttcccgagcagctgggactacaggcatgcgccaccatgcccagctaatttctgtatttttagtagagacggggtttcgccatgttggccaggctggt[133 bp omitted]ctatggaaatagcactgcaactcctgttaattgctaatcctgcatcccagagaaccccagtgaattgtgtggttgttacaagtatgagcagttagggttattttgaatatactacccaaactcttttaaatgtgtgactcctgttttgtgtgtgtgtgtgtgtgtgtctgtgtgtatgtgtcctagcttttctcatcctctagacagatgttagctgtgcatatatgttagcctaatcgggggggaaaacatgagacacacgtattataagtagagagtttatttagtccaagtttgaagattgtaacccaggaccataggttcaagttgccctgaatgtgtgctctgattaacagcaggaacaagtgagtttttaaaggaaaagaagaggcagttcctaaattgtttatcaagaatttacatgaaagtaacataaaatattgattggctgtacattgttctttgtatcacaaattccagggacatgaagctactaagtgaggcagcgagtcagaaataaaatgctttcaaacaattgcccccaggcatgggtacgagggtgagtgagtgtggctgaagtctcacatacacttgtttccctgggcctcataagttttgcatacttcacataactcagagtactctgagctataaaaatatctataaatattatgttgctaacattctcctggaatttgagtaagactggaaaaatcttacaaaataaatcataaacttctatctcaaatttctttcaaaatttctaaatgacatctatgcaaacccaatttggaaaataaattgtgaacaaaaaaaaaatcactttagaacttaccaattttaatggaatttcaagaaaaccccaaaacaaacaaaaacatatggagaagaatctctcttgtagaaatcactcaactgtaatatccctgaagtttaatttctttgcatggaaaagaaactgattataaaacttgtttaaaatgagttgaatgagatagtttaagagtaatgttcaatacgttttgatttaaataatagattgctcacagaataagtgtatgttgatttaagccttcattttctcataataggaaattttactgctttccacacagtatgacagcttgagttatagcacagcgggtcggagcaagagcaacaattgagaaccatgtgcgtacaattatgcaaatcccttatcatcgccccctcccctaggtctcatttaattgtcttcttctatatatgcagcactaatatttctagaatcagggaaaaaaagaaataaaaatgaataaagccttattcaaagccacaagtgaataaacacaatcattaaataggacaatatgcagaataaaaatagaaggaaactcccataaggaactaaaacaccaaagagagagaaaatattttaagactttgtctctttctgttgtaaaccatatggatgttccaaaccaaagcaaaaactttggtaaagttggaaggcaattcatttacaaggaataaacttttttctacctctgatttaaatttttcaccattttaatcctttattcttttcctgatttaatgcaatttttttttctcttggagatttgagaatgggacatatgctgaaccctataagcaaatgtcataactacttgtttgagatttatcttctttaaattgtatgtggtattttaatggggattgcgttgaatttgtagattgcttttggcagtatggtcattttcacaatattgattctacccgtccatgagcatgggatgtgtttccatttgtttgtgtcatctatgatttctttcagtggtgatttgtagtttttcttctagaggtcttttgaatccttggttaggtatattcctaagtattttttttttacagctactgtaaaaggggtgagttcttgatttgattctctgcttcatcactgttggtgtataaagaagaggtactgatttgtgtacattaatcttgtatccggaagctctgctgaattcttttgtcagttctaggagctttctggaggagtcctaaggattttcaaggtaaatgatcatatactcagcaaacagtggcagtttgacttcctctttaccgatttggatgccctttctttctcttgtctaattgctttggctaggacttccagtactatgttgaagagcagtggtgagagtgggctaccatttcatccagcaatccagctacttggtatctacccagaggaaaacaagtcattattcgaaaaagatacttgcacacacatgtttatagtggcagaattcacaatagcaaaatcatggaaccaacccagatgcccatcaatcaatgagtggataaagaaactgtggtatatatatgtatacatatatatatatgtatacatatatatatatatatatgtatacatatatatatatgtatacatatatatatatatgtatacatatatatatatgtatacatatatatatatatgtatacatatatatatatatgtatatatacgatgggatcgtatatatgtatatatatgatgggatactatgcagccataaaaaggagtgaattaacagcatttgcagtgacctggatgagactggagactgttattctaagtgaagtaactcaggaatggaaaaccaaacattgtatgttctcactgatatgctggagctaagctatgaggatgcaaaggcaggagaatgatacaatggactttggggacttggggggaagagagggaggggggtgaaggataaaatactacatatatggtgcaatgtatactgctcaggtaatggatgcaccaaaatctcacaaatcaccactaaagaacttattcatgtaaccaaataccacctgtaccacaataatttatggaaaaaattgtatgtaagagcatgattatataattatgtcataggtattgttcatggtattgtttcttttttcttttagtttttccttccttccttctttcctttcttcctccttccttccttactttctccttcccttctccccttctccccttctttctttccttttcttttcttttcttttctttctttctttctttctttctttctttctttctttctttctttctttctttctttctctctttttctttctttctttctttctctctctctctctttcttttttcttttcttttcttttctcttctttcctagcttttaatgattgccagtagtttctggtgttcctgggtttgcagctgaataactccaattgctggctgcatcttcacatggactttttctttattgtttgcctgtatctccatgtttccttttttcttataaggacagcagccgttggatttagagccaaccctaatgcggtatgatcttattttaacttgactgacattgggataatttgtgtgggtcagagtcctacgcataggtgggataacttagattccaagactagattctaaacctcggcttgatcactgtctgatattgggaaagtttctgatccaaacttcatttttcttattcataaaagcattagcaccagcaactctcatttcaacagattcatgtaaaaattaaatgaatctgtgtaacatgtggttgttggaaacccttggtcagatcctatctaaggattcaaacaccaccagataagcaacatagagtgaacacagcatgtctattttctaactcaccctgaaaccaaatttccaaatatttccccccaaaattataagtgtcgttctaaaggacaaaacaagataatgatagaattcctaggaaaattactttcctgaagaattagcttgcttgttaaagtatagggaggctagaaagtggtgtataatttagtacttccactaagatggacacattgaacccatgttcaattacatgccattattaaaccagctccaattatataaagcaaaggggcctttctgggcatccaccatctttttttgcatggggaacggattaaaagaaacgaggacatttcttgtttgaagcattttcctggctggtctcatggagcttggctgtggggtcttagcccattcttttgttttcctcttctctctgtgtgaatgaggctttctgaagggcctacgcttgttgagatattctgaggctgaccaactcatccaagtttgctcaggaactttcttgttctacctctgaaagtcctacatccagaaactcactctgtcatatgcaaactggcctatgactgtcatagccaccacagagcttgactgactctatcctttgtcagagaggtaaacacaattggggtgagatccaaatgctgtccattgtcttgtacaggagaacaaagtcacaataaaaatcctttgacttgtatgactttttatattgcctcatgtaagaagagactcatctcttatttgtcaggttgtaaattaagcatgtagcacagtctctacctacctatctagctaatttgctagctagctacctacagagttatctacttacttatctacctacctatccacctacttgtttgtctactatctactgaatacggcctaagtacctatctatattcctttctacccgctaacctacctacctacctatatatctgcctatctatttagctacctacccacctacctacctctctacctctctatttatgtgtctgtctactacttactaaatatgacgtagtacctatctattatatatattatagatcttcctacctagtaacatacctagtatctacttatctacatatctacgtacctacttagctacctacctaaccacttacctactaactgagctaaatatattctcacctacctatatacctacctgcctgtttactacttactaaatatgacctaagtacctatctatatgccttcctatctactaagctacctacctatgtagctagttagctagctacataccaacctctacctacatacttatctacttatgtatatacctacctacctacttataaataaacatacctacctaactatccacctatctcccctacctacctatctatccactgacctgtgtactacctactaaatattacctaagtacctatctatatacctttctacctactaagctacctacttacctagctagttagctacctacctaccaacctatacctatatgatatctactaattataaacttacctacctatccacctatctacctacctacctacctatccacctatctacctacctacctatctacctactaaatatgacctaagtacctatgtatatacctttatacctattaagctacctatctacctagctagttagctacctacataccaacatatacctacatacttatcttcttaactatctactacttatgaatatacttacctatccacttatctaccctacctacctatctacctacttgtttactacctagtaaatatgacctaagtacctatctgtttacctttctacctactaacctacctagctacctacccacctacctatttacctacttacttacctaacaatccatctacctatttgcctaccagtctaagtaccatgtttactaccaactaaatatggcctaagaacctatctatatatgtttttacctactaacctacctacctacctacttacccacctacctatatcaaactagctagctacctacatccttactacctatctatctacctatgggaaatctggatcccaaaaaaagtgagttttggaaaccacatcctagcccctgttattatattgccaggttaagatgtagttctgttttatttttgtattaattcctctgtggcaacactcacatcctgtcattcatacttctggtaaagcgtacaactggcttgggcagtgatgattgcagggaaccttagccactgctgttggcctgaatcccccactctctgggtccttgcatctgcccattgttcagccatttgtgcctagtcttggctgcccctgctgggcaccagtcaacattatagggctctgatgataaacaacttaacagtttccctgatgccctttgtaaaacgcatactcacttacaccatgcttcacacattgatttgaaaaaagagattcagtaccttatttaaatacaccaccaatttagtaaaagacatgacacaaagcattgagttatcaaatcacatcctctggagtcagccaggtcaggctttactgaggatattagaggcatgagtaattttgcagtatagtaaactagagatatttgttttcctccatcaagactcctcaagtttcctcttctctcattgcatgtttctagaccaggttgatggatgaggtttctaacaaaaacccatgaccattttaccatgaaaaagaaatatttggggtcatggaatatctttttttttcctcagttgcacagcttaggtgaaggtttccagggagctatgtcacatagatccatagatgtcatgtttccttgccataaaacaaacctaaagaactaggtacgtcgtgctaaaccattccatagataaggattgtcttgctagccagaaccacttggttgcctcactatgaggtctgctaggagtataattagaatgaaatgagcctgaatctcttgtgttaacccccacactaaaggaaatggatgggtagaaaacctattactttaattgttggcttcccagtgaagaaacctaagatttttactgttattaacatgtacaggcactatctcaacacaacacactctctctttctctctctctacttagttagctttaagccttctaagtctgtaaagtatactttatcatgtcagaaaagaagtttgtagtcaattttaacattattagaatagtgatatttaatatctaggatttaattgtgctaacattagtttttcaagcaattagaataataaagttttctaaaagagatctaaagctgtcattaaagggaaaatcaacatctttgaattattaataaaaattgcttagcaacctgttccaataaataataataatatcaacaataaataataaaacatccccccggcaattttttattattgattacaaatgaaactaatgtgtcatttgttggtgaaaataatattaaagtgagcaataagccatttttaagcaataataaaaaatgtgattttttattagctttgttttgctttcatttcttctgctactgaattatttgatattttatgaattggttgatgtttgccattggtagacgttcaaaagaaaatagaaatagaagattattctctttcataatgtttgcattagtaatgttgcctctatttaaagaatctgtaaatcctacaatatatgaaattgtcgccgtgataaccaatctttgattcattgggtttactctgttagtagccaccctccattttttgcatgatagaaggtggattggactttagtccattcttcatctttatgtacagaagtgcaaaaaccattttagctaaatgggcccttctggttttagagctttgacttaacaattcattagtgacctctacagtaggttgaggggctagtttgtaagacagtgaagagcaccatatcaactgcctatttggtaatttagtctaagctttggatttcccactggttgagatataattttgagtggacttttagatgagaatttaaagggttgataaagacatctctaaagatgaccagggcctgggcgtggtggctcacacctgtaatcccaacgctttgggaggctgaggcgagtggatcacctaaggtcaggagttcgagaccagcctggccaacatggtgaaaccccatctctactaaaaatacaaaaattagctgggcgcagtggcaggcacctgtaatctcagctactcgggaggctgagggaggagattcacctgaacctgggaggaagaatttgcagtgatcagagatgtcgccatcgtactccagcctgggcaacaagagtgaaactccatttcaaaaaaagaaaaaggatgaccaggagcaaattaatcacatgaattccatcttgctcaaaagatattacaatcaggaaaaacatgaaaaaaaatctgagcaaaaagacaaaaaggataattacatgtctttgctatttagttctactcctcttttccttgtatctttttgtatatccacctctgcagtctactggtacctctatgttcagatccaatatcgtgacctgcccttgggattctctcactcttgctctttgtctcacctctacattccaatgtcttacatagctttaccaaaaacaagcaaaaatccttagagatccttgatgtttttcttcttattcatggttcagtaaatgtctgtagaatcaaactcttctgctatattgattcaatcatttattttctctcatcgatttgttctataagagtcacagacttcaccttcctgagtcctaagaatttgtagatacaggatggaatgtttcccagtggtaattggttaggagctgctacatgttacatttattgttgtaatttgagtggaaccttctgtcagagaagctctgtccaatgcatgaagggactatctgggttgctatgtttcatgtgcaattacagatgactttctcttgaatttccatctgggatgtcttctgtagatcccatgacaaatcatgttgtcacacatgttattaaagaaattcaagaccatctcatcccatgaggtctatagatccccttatctgacacaaattctttatctcccaaagttctcaatttctggaagcttccacttgccttgtggcactcataaattttttaacaaaattcttcttaccataaacactttttgaatgtttcctttactttctttttctcattgaaagcttggcccttccttggcggggtaaaaatttgttggcagcatccttcaatagagacagtctcgttttcaattttctcatccctagtgctagaggtggcatggtgtctttttgcctgctgacacccttctccagaatctcctcttttaaaaaggccagctttggagctcatgacattggccatgaggccatgtcaatttccctctccctccaagggacagccattcaaggaatccattgtttgttgaaaattttagcatgggattcacaaacactacttctgttttagtaactgaagattttaaaattcatggggtttcaacctcaggtacatattgacatcttggaggagctttacaaaataataaagcctgctctctgtccccagagagattcagattctgtgacttgggctctgctttcagaagtttcccaactgaacatgatgcatagccaggattgaaaactacacacataaatggtcttttcaataccttggcatttccatttatttatctcttgcatagatttccttgttcctaactctgacgtgcattcctatattctcgaccttctcattactcacaaccaaaaacatagacaatctttccaatgcctttgtatttccatttctttatgtcttctcttgcatgtttttccttgttcctgactctggcatgcatgcccatactctccaccttctcatcactcatcactctgacaccagttttaatgattaacatcctctaattaccatttatcactttttcatttgtgttcctcacactgacagtcttcagctctgctaagactgaaacttactgttttttgtttgatttttagcactgcattgctatcttttgccctgttcctgttcttatggccactcttacctatcttcaatgacaagtaccatcatgctactccttgcttgccttcacctatgactccctttaccctctggaaggaaaccgcacttgaaaaaaagaaaaaaattacagtgacagattggtatattattatacaagatagactaggcgatgctgcagtaatgaaaatcatatactaatttgcagtcccttaagctagcaagggtttatttctaactcttgacaactgttcagagaagctatttcccatgcagatggcagtgttcctaatttgtagctcaacaatctgaaacaggtggcctccttagtgtatacaggaaaggaattagtgagaaataggtgaatgatctcactcaatagccaggagcctgagacatgcagtctctatatgtctggaggggaagacaatcctttattgatggatactagtaattatcagggattttggggggtttacagattatattattaattttttcaattatcctactttattctagattggggataacaggcaataacaatatattattaggtaacacagtgaattgacttctctactaatcccttaattttttttttttaatttcaatagttttgagggaaaaggtggtgttttgttgcttggaaaagttctttagcagtgatttctgagattttgctacacccatcaacagagcagtgtacactgtacccaatatgtggtcttttaccctcaccccgcttccatccttctccccaagtccccaaagtttagtatatcattcttatgcctttgcatcctcatagcttagctcccatttataagtgagaacatataatattaggttttccattcctgagttactttacttaaaataatggtctccaaccccatccaggttgctgcgaataccattattttgttccttcttatgactgagtagtattccattatatatatatatgtgtgcgaataccattattttgttccttcttatgactgagtagtattccattatatatatatatgtgtgtgtgtgtgtgtgtatgtgtatatatgtatatatgtgtgtgtgtgtatatatataactttttctttatccacttgttggttgatgggcatttaggctggttccatatttttgcaattgcaaattttgctgctgtaaacatgcatgtccaagtgtcttttttatatatacacggacttattttcctctgggtagatacactgtagtgggattggtgaataaaatggcaattgtgaaggttaatattgaattcaacttgattggattgaagaatgcaaggtattgttcctgggtgtgtctatgagggtgttgccaaaggagattaacatttgagttggtggaatgggagaggcagacccgcgttattctgggtgggcaccatctagtcaactgtcagtgcagctaggatagaagcaggcagaggaacgtggaagaactagactggctgagttttctggcctccatctttctcctgtgctggatgcttcgtgccctcgaacactggcctacaacttttggacttttggacttaacaccagtggtttgccagaggctttcaggccatcagccacagactgaaggctgcactgttggcttccctatttttgagcttttgggactcggactggcttccttgctcctaaactccctttcatattacatctagcctattagtcctgtccctctaggaaaccctggctaatacagtagttcttttagtttttcaaggaatctccatactgttttccacagtggttgtactagtttacattcctgccagcagtgaacaagtgtctccttttcaccacttccatgccaacatctgttatttttttattttgaccagagtatgattgagctcattttcttgatcaggaattgaaggtcagagttgttatctaatttattcaaacttctctaccggtgagaatgatgagatatgaataaaggtttgccttataaccaccacgagttctactccaatagcagaggaataatttatcccacaagagaatgccacacctggtttagaggtgtgatttgaagatcagttttatgttccctcttcctgtattcattggtgataagcacttcaatttttagcatcttctgaactggcttccttttggttcccaaagctcctggttgttccatcctgaacagattcgtatatttgagttgttttcctgaccaaggaagccatctgagtttgtggttctgccctttaacctctataaagcacaatcacctaagatgcagtaacccaaggcaagcttattttagtggaatatcagtcctgtctgctagctagctttaaaacaaaggcctccacaattaactttgtttaatctcttgccaaccagctgaaaaagtacaatcaaaactgatgacttattttattttttaagaccttaatcctgcaaatattagaccggccatggcacacaagccttgaataaatcagttgaaaaaaattttcatttaaatgaccagcatttataaaattcataaaagaccagcagtcataaaatgtcctctttgcttggtctcctgatcttagtgaactgatattaccctttccaataaataatgtttcaggattatgagtgctttattctgttgatctcttccctccaaggagcagagtgggtgtcagggagcatctacttaatgtctgaacttcactgtgtctggatttagcttccagcttcagatacattttggttttaattgtgtttaacttttaatgactacaaacaaagcccagcaaaataaaattcatctaccattgcatctgagggagaggtcctccaaaaatcaattgcacttagttaaaacatcatctgtcgcattaaatagatcactaactatggatccaattctcctccttgcggtcttgtctcaggaaattgtttggaaaagcatattcagaccttcaaggtcatggtctgggacattatgtagccctggattgaatgagctattttgaaatataccataaattctttataactattgtccccctactgtgctactgaacactagaacttcttattttttctagcaaattgtattcttattttttatttttttagagaaggggttttccctgttgtccaggctggagtgcagtggtgtgattgtagctcactgcagcctcagactccagggctcaagcgatcctcccacctcattcatccttcaaagtagctgagacaacaccatgctcagccaaacttaattttgtgtgtgtgtgtggagacagagtcttgctgtgttgcttagtctgatctcaaactcttgacctcaagcaatcgccctgtttcagcctcctaaagtgctgggtctataggcacaaaccacctcacctggctcctaactgtatttttgtgcttattatctcaaggtcatttaaaatttctctaaacgatatagttttgtggagaagatccttcacatctgtcattatattagttcctaggtacatggtgtttttaagatattggaagcatccccttataaaattcattttgctatttgttcctgactctgttaatatcagcaggtgtgcaatgggctgagctgttttgctggagtaggaggtgtagctgcatgacactgatcctgattgaacatctctggatgaacttgttaaaaatacactcttgagtcctacctccctcctgaatttggtcccaaaatatttcccacctaaacaaaaaagttatactattactctaacagttgcacagactaaaaatctttcttctgcccttttatgaataacccacactcaaatctatcaacttaacgctatctgctcgccttttaaaatatatccagaacaaatactttccagtgccataatactgtctttttcataccccatcgccttttccactgccagttatgatagcctcatatcagtcttctttctgttatccttgtcctccttcagtctgtagttggagtgatctttttaaaaactgaataagggaacacctctacttttctcaaaaccctccaaggattcctatctcaccagggtagaaacaagtccttagaaggcctacaagatcctcatccatctctcttcccattctctctcatttctttttgtcaactccattttctgtgttccaaccacacttctgcccacatttcctcaaacgtcacaatcccactgctatattaggagttttgtctttgccatttctgttcctttgttcttgcatgctcttcccagcagctatcaacatcgtgtgctttctcacttccttcaaaatataacattttcagagaggtattcccaaactactttctacaaaagttctctgtgacttgccactctcaatattgtggattttctttccaattattacggttacctgaataaagacatattcatttgttcattaccattcttcccctactagaacgtgaatttcataaaagatgagctttatttgttctgcatggtgtagtatctcaaatgcttaggagtgtgctccacctatagaatagtattattgttggtgcaaaagtaattgcggtttttttgcaaaaaaaaaaaaaatatggaaccagcccaaatgcccaccaatcaatgagtggataaagcaactgtgttgtatatttatacaatgaaatactactcagccataaaaaccaatgagttaatggtattttcagcaacctggatggaactggagactattattctaagtaactcagtaatggaaaaccaaacatcatatgttctcactcacaagtaggagctaagctatgaggaggcaaaggcataagaatgatagaatgaactttgggggcttgacggaaagagtgggagggggtgagggattaaaaaactacaaatttggttctgcacaggagagaaacaggaagtgtgtcctgcacagggaagacaggaggtgtgttgcacacaacggaggaacagaatgtgtgtgctgcacaggggagaaacaggaagtgtgtcatgtacaggggaggaatggaaagtgtgtcctgcacagaggagaaacaggaagtatctttgtctcaggagaataacaggaagagtgtcctgcacaaggaagacacaggaagtgtgtcaagaagaggggcaacaaaggaagtgtgtcaagaagaggggcaacaaaggaagcgtgtcctgcaaagaggaggaacagaaagtgtggcctacacaagagcaggagcagaaagtgtgtcctgcacaggggagacacaggaagtgtatgctgcacagaagaggaacagaaagtgtgtctgtctcaggagggtaacaagaagtgtttcctgcatagggaagaaacagagtgtgtcatgcacatggcagtaacagaaagtgtgtcatgcacagaagaggagtggaaagtgtgtgctacacaagaaagaagcaggaagtgtgtcatctacagggaagaacaggaagtgtgtcatgaacagaagagacacagaaagtgtgtcctgcacagtagagaagcaggaagtgtgtcatgaacagaggagaaacagaaagtgtgtgctacactgagaaacaacagaaggagtgtcattcacagaggaggcacaggaagtgtgtcttgcacaggggagaaacagaaaatgtgtcatgcacagaggaggaatggaaagcatgtgctacacaggggagaaacaggaaggatgtcatgcacaggagagacaaaggaagtgtgtccttcacagcggagaaacaggaagtgtgtcacgcacagaggaggaacagaaagtgtgtcctgcactggaaaaaaaacaggaagtgtgttctgcacaggggagaaacaggaagtgtgtcctgcataccggaagaacagaaagtgtgtactgcacagggaagaaacaggaagtatgtcctccacatggaaaaaacaggaagtgtgtcatgcacatcggagtaaacagaaaatgtgtcatgtacagaagaggaatggaaagtatgtgctacacagaaaagaaagaaaaagtcagtcccccacacggaagaaactggaaatgtgtcatgcacaggagatacacaggaagtgtgtcatgcacagaggagtaacaaaaagtgtgtgctacactgagaagaaacaggaagggtatctttcacaggggaggcacaagaagtctgtcttgcacagagaagaaccaggaagtgtgtcatgcacagaagtgaaacaggaagtgtgtcatgcacagaggaggaagagaaagtgtgtactaaacagaggagaaacacgaagggtgtaattcacaggggaggcacaggaagtgtgttttgtccaggaaagaaacaggaagtgtgtcatgcacagaggagaaacaggaagtgtgtcttgctcagaaaaggaacggaatgtgtgtcttgcgcaggaaaagcaggaggtgtgtccttcacaggaaagaaacaggaagtgtgttctgcacagtgtagagacaggaagtgtgtcatgcacagaggagaaacgggtgagtgctacactaagaagaaacaggaaaggtgtcattcacagggaggtacaggaagtgtgtcttacacagggaaaaacaggaagtgtgtcatacacagaggagaaacaggaagtgcgtcctgctcagggaagaaacaggaagtttgtcatgcataggagagacccaggaattgtcaaaagaatgcaaccatttgtctctcacctacctgtgacctggaagcccccttctgctttgagttgtccccacctttctggacagaactaatgtacttcttacatgcattgattgatatctcctgtctccctaaaatgtataaaaccaagctgtgccctgaccaccttgggcacatgttgtcaggacttcctgaggctgtgtcacaggcacgcttcctcaactgtggcaaaataagctttctaaattaactgagacctgtctcagattttcagggatcacatgaccatctgattgttgggtacaagtccaatctgtgctataaccagaactggcagaaacatccccattgctaaggcatgcacttggtgcccaacattttagttaagctttcaaataccactcattctgagccctatcacctcactatgtgtctttccctccctgttctacgttggacttggtgaggacattgccctggcatccatggtcatctaagaccattgagagggggttcctcaaaggcaagaagaaggttcctgagtcagccgagtcagacccattttcctaaaggcaacttcattttccatcttctctcttctccccacccatgccttcttgctctctgctttatccactggagggtgtatctcttgtgctgtttctcactaccaacactgttctttatcacttttttagttactctggctgtctgtttttaatagtctatgtaagaccatgcatggtggctcagatgggtttccagaaattactacaagatgttgggaagcaaaaaaaaaacacttctaccattaggatgtttgacaaatcctgctaaatgtggctatcttaatttgtatgcctctgaattttgtggatttctttctcaatatcttgtagaccactgaaccttcgaaaacactactcaagttcgctatatctgtaccactcttatcttattttcttttatatagtcttgctttgagtttttgcatgtgcttggttgaggcagaggggaaaagaaaataaaaaaataataatttctaacccttagtattaattcttgtatctatttcttagaaaaaaatatatcaatcaatcatctatcttacctgtctgtcatctatctatcatctatctgtctgcctatctgtctatctatctatgtatctatctatctatctatttatctatcatctatctatctccctatctatgtatatcagttacaggcaaaatttgtatcccaaataaaagaaaattataaataacaaaattcattaaaagtggtggtgataaagaatgcttacataagataatatatatttcccattttcttgcatatttatagatgtttggtgaataaaggttatcactagtttatgtggaactttattttacatacattaagatgcaaaataaaaattccaaatagcttgtccaagaaaatctctagtttattattacatctgatactctttatttccatacctttccagatactatgagtaggagaccatggaaagataatatcttaatagcttctggtgccgttcctcaaacagcagaaaacaaatataaaataaaaatttggatgtggactttcactttttccatgaaggagtaatgagatgaatttattccaccaccaccaccacctcaaggtataactacataactaaacagataggatggcaacagttgcacaaagaccagaagggaataactgaaaaacagtttttgttttagtatcagaagttttgagcttctgatactaaaagtgaagtagtatgatatcatttgaaactagactgtgataagaaaaaaaaaagtgtacccgtaaactctaaagcagtcacaatagtaatacagaaaataattaaaaccaataaaccaacacaattaaccagaatggaatcataaaaacaccgaatccaaaggaaggcagaaaaagagagagaaaataaaccatgaacagatgggacaaataaaaaataaataacaagatggcagtttgaaacacaaccatatcaatagtcacattaaatgtaaatgaaccaaatgcccaaattgaaattcagagatggtcatgttgaataaaatatacatgactcaactctatgctgcctccaagaaactcacttgcaagtagacatttgtagaacattccatctagcaaaattgatcattagattttaacaaagtgaaaaacgtctactttttttgtaagacactgttaagacaatgaaagcacatgctacaggttgagagaaaatataggaaaatcacatgtgatgaaagatttttatacagaatatataaataactctagaaaaataataagaaaataagcaacccaattaaaaagttggttaaagcatttgagcagacacaggaaagttatgctaatggaaaataagcacaagaaaagattctgaacatcatagtcattagggaaattctgttgaaaccacatgaaataccactatacatatattttactttttaagaaaaaagtctgattatagcaagtttgtgaagatatggaggaacttgaacactcacgcatccttgataagaatgtaaagcagtgaaacaactttggaaaacaattttagcttctttaaaacaggggtcctccatcccccagccagtaccagtccttggcctgttaggaactcagccacacagcaggtgagcgactggtgaatgagcagagcttcatctatatttacagccactccccattgctcacattacttcctgagctccacctcctgtcagatcagcagcagcattagattctcaaaggagcatgagccctattgtgaactgcacctgtgaaggatctaggttgtgtgctccttatgagaatctaattcctgatgatctgtgactgtctcccatcacccagagatggaaccatctagttgcaggaaaacaagctcagggctcccactgattctacattatagtgagttgtagaattatttcattctatattacaatgtagtaatcatagaactaaagtacacaatcaatgtaatgtgcttgaatcctcctgaaaccatccccctcctctccctacccttgtccatggaaaaattgtcttccacaaaaccagtccctggtgccaaaaagattggggactgttactttaaaagttaatgatatacctgatttataactcagacattttaatcatgggtatttatccaaaatatatagaagcacttacccaaacaaaggcacgtatacaaatgtaaataacagctttatttttattagcaaaaatctggagacaaactgaacctccatcaagagttgaatggataaacaaattttcatgagtacatacagtgaaatacagtccagaaattaaaaagaataaactattgatacataaaacaacaccaatgaaccttgaaataattttattgactaacgcaagaaaataaaaaagaatgtataacacatcatggcatttatgtaaaattctagaaagtaaaatctgtagtgacaggaagcacatcagtgttgcctgtgtttgaagacggaaaagggagagggaaaaatttcaagggaacataagaaaatttggggaattaatggatatgtttattttattgatagtggtgaagtgtcaaaatgtattgaagtgcagactttaaacacccatccagttgattgtgcctcagtgatataactgaaaaatatagtaggttctgcatgattacttagaaggtgcttggaaaaaagacatttatacccaactcgacaaacataattactgtttgggacagtaattcggatacattatccttttttcattagagaatttgtgttatcataaataaaaatatttcatcataaaatatttaattagatactataaagagacaccattggtttaacaattcaattcaaaattagctgatgttccagaattctcacttcctttctcccagccaaggttaccccagttgtaattcctgaagctgaacttaagtgaccatgcaaacattcagaagaatgtcaggatggagtttgggttttaattaactaagaaccctgaatggagatgggaaacttactacgagtatctaagaagagaaactgaaagcaggaatggagaaagctttcatcagagtttagaaatcttcttccctgtgtgattcaggaaaatgctaagttggtttgaccctcaacatgtgtcatcccacattgagtgaaaactccatctgaaagttgtctgaagcttctggagtccaggattcctgacagaacttgagacctgtaaatccaaccatctggggcttttggggaaatctcatgaaggtggaaggggtagctgactttccaatgttgttggcaatggaatcatatgggccaccaatatggatttcaaggggaaacaaagatcaaagagatttaaaccttctgattggcttttatcttggcaaaacattaggttataaatgtgctcagagaccaaacctcagtatatttgtacattgaagatggatacagggaacaaaagctacatacttttaaacaacatatttggtgagtttttagttatgtaattaccatacaaataaacagaaggtgatatataattgaagagaaggcataatacaattttgacaggtggctgcataagtaactcgtttatggaagaacattttaataatcaaactctctgcatcagtttttccattttttttcaacttttgttttagattcagggggtacatgaattaccccaggtttgtcacataaatatgttacatgatgctgaggttttgggtacaattgtactgagcagagtggccaatagttagtttttcagcccttggcccccaccctgcagtttctattgtctccatctttacgtccataagtacttaatgtttagctctcacttataagtgagaacacgtggtatttgattttctgtttctgcattaatttgcttaggataatggcctctagctccatctgtgttgctgcaaaggacataattttattcctttttatggctgcatagtattccatggtgtatatgtgccacattttctttatccaatccactgttgatgggcacctaggttgattacatatttttactattgtgaatcaatttctctaattttaaaataatgctggttgatgagctttcagtcatataaaaaacaagtctgtgcaagtctgtgcagcatgctttaatctctcagaatcaatgacttgttttacttgaaattgtatttattttccttactcctagagaatttacaaagacttctatccttctcttttttctttttttttcgtcatcgtcttctttttttttttttttttgagatggagtctgactctgtcacccaggctggagtgcagtggcgcgatctcggctctctgcaacctccacctcccaggttcaagcgattctcctgcctcggcctcctgagtagctgggactacaggtgcatgccaccacgcccagctaatttttgtatttttagtagagaggaggtt[142 bp omitted]gtcacagtcaacagtgaattatcacaaggtaagtgagcaacttccagcttcaagaaacatatggtttccaaatttagatgcagagtgaacattttctagagtgagcattctaacaaatgaagctttctattataaatattataacaatttataggtaaataagccttgaaggataatgatgtaaacaaacatctaagtattatgggaagtttttgatctgctttagtaacacacttagaatctcaactttgccataacaacacgtggcataagagtaatggttactttttatgacaactgctctattaataccctctggctgcttccttttctaagtaaataaaaaataactaattcatttgtttgcattttcaaatctcttacttcagcaacttcatgcaaagtctctcagtgagtaccattgaattttaggtgctaaaatattttcaagagaaaagaaattaagaaaacgcggaggtaattaacacagaaagagaaaaccaaatactgggtgttctcacttatgagggagatgaacattgggtacatgggaacataaatacagaaataacacacactgggaactgaaaaatttcctattggaaagggggcaaggactgaaaaattttctatgcagtaccacgttcattatttgggtgacgggatcaacagaaggctaaatctcagcattatgcaatatactcttgtaacacacctgcacaggtatcctctgaatctaaaattaaaaaatacatcaataataaataagaacaagtcagaaacaacaaaattaattatataattttgttgataatgaatttatggtgaagtcatgtagttagttttactttataataaaatgatactttttcttcctaagagtggtagagattttcagttacactcaagggcttataccatttgggcatactgacttcctttgaaaagcagccttatgtgttactatatgaaatggatatttccagattccttgagggacttcacctaagattttcccctaggtatacaatagtgactagatttttccgcctgtacaacacttcacttacatggaataagtagacaattcagattagtaaaggtttaaaatatgcatggactcatgaacgtgcctgaccacatacctaagaaaagaagaagaaaaagaaaacacagaagtttcttaactgaagacagttggattggattttcttttactgagatgaaggaggtgatgttgggaaggcatgacatctcttgggagggcaagtgacagctgggttttgtgaatgaaatggcttatctgtcggcattgttgtttctctctgtatctactgtctagagagcacaaattcaggacctgctaaaacggcctgcagagcagagacgtctctgagcctgttttcagggggtcctcagagagagctcattgaatggcattctttttgatagaaggcgagcgctgaggtaataagtgggcaggacattttgagacggaaggagaggaagaaaaagtctctttacctcccgtgcctgcctccacatctctagaggtgaagaggagtctgtttcttgatcataagcaggtctgggtgggaggtcaaaagaaagttgaaatttgggaaaatttccaaaggtaaaaggaaacaaagtgaactaaagctcaagctaatgtctctattgccaaggacttacagaaggtgttatatctagagtagattgactttgaaaggtggctgagaatggactataaagaagtggtttccccaaacaattaccagcaagaaggaagaacagatgtttacacggagcaagagacaaagactatgagaacaaaatatttggcatagctattatatgtttacaagaagaaaaaaagaaacagcctcagggaaagcgtcaacctttttcttatatctagaagagtctggaatatgaaagatggtactttgtaatgttttatttacctcaaaaatcaacataaaggtgtttgagaattccttgtatagcctcacaacctttctttgcttactcgagttttgcgtctttgcaggtgatcaaagtgcgtgctcacatgtgggtgctctgttccatagaaagtttcctctcctgtaatgctaccctggcaacatcaacgtacaccccatagacacctgtcacagaaacttgagtcttgcctctggccagtcctgaggcacaaacagctttatgagcaacagacactccacagacaactcaccctttgacatgacaaagcaagatatttactaccgcttggtagacacatgtttccacaaggaaggtctatcattttaaaaatatcttgccagtttttcgtttccttccacctgcttttagagtttaaatcaagtccaggagcaatatagtctcaatgcctgaggtttaaaaggggcaggatttaatcattgaaaacaatgtccattggcttattcctggggtttgcttcatggtatgtctcctacagctgggcgttgttttctgaaacaatctttgcacgcttgtcgccatctgtaaagcaaattccgcttttggaccagaagggacttattcaaatgtaaattgccaccgacttcttccagcttaaaccctatcctaagaaagagaccccctatcctaagaaagagaccccctagcctgagtagaacacgagaagccccatgataactacaaggatctttgtttctctgcagctactttccttttgcacctgctgtcttttgggttatctaacattccttgcacatcccctaggcctttgctacccccggtggctcccattcatcctttcggtgactgctcagccagcctagaccaattcactctgtttgcccactccctcttcttcatccacagcatcttgcatttcagatgcctctcgccaattttcttttaattccatctgcttgctccatttcaaatccctatctgctccatcagcctcaaagctccttgagtctcgttttgtttagttatttgtcattttttggagtcagactgcctagatgtatctctcccaccatgaactgtccatgtggctctgagccgttacttaatcttttatgcctcagtctttcatctgtaaaatggggagggtatgccaattgatttattaactgaggattcactggaatgattctggaaaattgctcaacaccatggcctaccatggatattaaccaatgtaatcccagttctacaacctgatattgaggggtagagtgaagaaattagtatgtaattttcatggctgtaattaacaaaccacaaaaacataaaaatggtctcttaatttcatagggctgatatacatcaataaaactttgaatgaattctgaggccaccatagttccaaaataatgtaagtccattttatgtgatatatttatttattatgtgataacaaatatattatgtatagaatattaataatcttaatacttataaattatacacattaaaattttaatgaagaattaaattaataatttatattataaactataataaattgatgtccctctttttccttttttttctttttattttgaaagagacagtgtctttctctgttgtccaggctggagtgcagtggtgcaatcatagctcactgcaggtgcatggcaccacacccggatagtttttgtgtgtgtaaagaaggggtctcactatgttgcttaggctgatgtctctcttttcaatagtgaataaaaattcaatgaataatgataaaaccatttcatgattggccacatttttaatcagctgtttctattatcagcacgattgctccatcttccaaacacagctctttcaagaaatattattttctgtaagctttaatgcttgatgtggttttttttcaacaggttttttgaaaagtgtgaaacaaaaggattatatctaatgattattttctacatattgggacataaagtacataggtcatttccaggtgcagcctggagtcacaaacaaaatgatgactttcataattcaacttatgaatgtatgaaactgactctgaactgaatgttaaaagggtatgtaaagaagtgatagcaatctaacaggtttagctgccagtagtagatcatagatttcaaaaaaggacatcttccctaaaatgaagtaagtggatacttaagttgtactttacaatgtatttagattttgggggtgttaaattcacattgttcacttgcgtatagtttcattgcaaccattcagtcaagaatattccgaatatccatgcaaaaaccccctaaattatttactcatatgtggctggtctgttttcctctaataaagagtatcaaaaaactatgaggttctcaatactctgacaataaagataaatctataaggatcctgacttttaagctatgctgaaatttactttcatcctcttgtgaatcaatatcataaagatgtaggtatatagaaaaaaaaattcctacatggaaacaggtccaaagaatgactgcatatctcttcagcgatatataggaacattgatttaatggggccaccaattttgtttttagttattgaaatgaaggtaattttctttgactcactaattatgaattaaggcttagactatgagaagtcacgcattaacttgtagaagtctaataagttgcaaatggttagtgacaggtaggaaaataaaatgacctcaaaggttacagctgtgttgctccttgaagctttaactacttttggatataatttatccaaatgatttctgcatgttttccctcacattatgtaaatatctgtatctcaaaggcttatttaagtcaactgtgtcattttgctatgtgcctggtgtgatggtcaatttttgtgcttcttacaacatttgcaaccgacccactctctatgaatacaaaaaaattagccaggcatggtggtgggtgtctgtaattccagctactcggaaggctgaggcagagaattgcttgaacccaggaggtggagactgcagtgagccaagatcatgccattgtactccagcctgggcaacagagcaagattccatctcaaaataaataaataaaataaatatttgctttcagtttattctaagggatcaataatatagatttctttggtgtgtttttttccttaagaagaacaaaataaaggctgtacttactagattttaagggtcatcctgtttagatgcattttacaataatagtttccatggactatggtaccatacggttaagcatatttgtattgttcttcttacctgtagttgttgagtgaactttggtgtgttgtataatttttctaaaccactcagcttcttagtttccaaaatgaagttctgatggcacaatgcaatcctgatcaccacttctatcaatgcaagtggcccaagattataagtctaatccagcgggaacatgaagtccttaggtttgatatgttgcatttggactaagaaagataagaatatttgctatctttaatttttctcttacctatcctgcaatcaatttatcttatagaattactggcttgtctataataaaatacagaagcaatgattacttttggactttattgttcagtatttcatggtgagtttaccgagtgaatgtagttaagtgctgttatggagatattatactttaaccaaagtggtttagttggtttcatatatcatgtagtgctattgttctaaattctgtttgaatttggagtttgcttatgaagccaagggaaattcataccttgtggaactcactcaaggacatgataaaaatgaagaatcagtcaagaaagcagtatagctttgatgtacttcatctctgagtcattctaattggcttctggtttctatcagtgaccaaccgatgcttaaataagtggtgaaaacattgccttcacctccaaggctggcgaaatgatggctcattggttccatgataatctgttatagaccttctgcttgaaagtttattacccttgtgttggccttcaacagaaacatgattagttttcaaacccttgtttactaaactcagtcactctatgcagctttctctagtggagtcagtaatatactttataaatggatttcagatatctaaatagagatagccatttaactccttgacaacaaattcagtagaaggaagacaaaagaatagtccttaatttactagtgaatgaacacattagcgttgttagagaaaccacttaactgatctttattgaataagcctagggtgtgtcctgcagaggggagaaacaggaagtgtgtcaggcacatgcgagaaacagaaagtatgtccataacagtggaagaacaggaagtgtggcctcttcaaggaagaaagaggaagtgtttcctgcactacagagacacaagaagtgtgtcctgcacaggggataaacaggaagtgtgtccagcacaggggaggaagagaaaatgtgtgttgcataggggagaaactgcaagtgtgttacccacaggggctacaaaggcagtgtgttctgcctaggggagaaacaagaagtgtgtccttaaaaagggagaaacccgaagtgtgtcctgcacataggaggaacaaaaattgtgttcccctgagggttcaggggagacagaggaaatgtgttcttaacaggggagacagaggaagtgtgtccttaacaggggagaaacgaaatattcagactatttctatatatttaatttatatatctttgggtttgtttacatatagctgtatatgtgtgtgtttatacatacatatatttatttaaaataggcttgtctacaaagaaaattaccatgctatcaatatattataaaatcacacatacacacatatacatatctttctgagaaaaattaaagacaataatttcacccctttttagtagaactcacaataaactttcaatggagatgcttttttaagaaaaacatttaacaattttttaaaaacttttttttacaagaagttttttaaaaacattttttaactttaaagcattcagtccataaatgtgaagttcaaagggctgtcatcaccactgttattactgtaaaaatgtggcggcccccttctcattttttctcattcatctatctttgatgattggatttgaggtaggaaacacacattttaatgggggtggactgagaataacatttaaagtgtgatacgtgacttaacacacacagactagtttcaagaatattgatgactgtcccaacatatgtcttcaaatgccttttctccccatgcagatgagagagttttccagttcttgcagttgaagcccatctgatgctggctgtggaatctaatgtgtcttgagtttcctagggtttgtcttctttagctgtgttaggacaatgaagacaagtctccaggttgcccatgagtccctttatacattattcataaaggttcgatgatagaataaattgctgtagtactaattcaggtctctctacaagcccactataaatctttttctattcaagaaaccaaccatttatcacaataaataagtaaataaattctccttttctgagaactcccatatatacacgttgaataaatttgcatgccttttctcctattaaaaataaaaataaataaaaaataaattctcttaaggcatgtgtgtgtgtgtgtgtgtgtgagtctcttccgaaggaacctacatttttgccttcccaaatgtgtctgattcttcattttccccctttattatatacgtatcaattaaacgtttttctttctcgtatctgaaccattttgaaaagtcgaaccctcctttcctacagtatttcattagccatttgcaaactgagcagctgaaagaataatggacacttagatgaggttcgacatggcttccccaaggagatctgaccctcgatcaagagaagtagacccattttaccattaagttaaaagatttagacacctaatcagaataaatgaaactacaaaaaagaagtcttattttttttttaaccagaattgtacattccattttgtttatgttagatagttcattgcatcaaagcctgctgtgttggttacttttcagatctgttttggtgtgaactctgcattacaatgaatccaaacatcagaaatccaaaggtgttctcatgttaacatttactattagacacataatgaaagcatcttttaaattacttacttaagccttacaaagatctttaaattttctcatgctaattttaaagacttgaaagggccttttataaactgcttctagaaataattgaaataattccaaaagggctagtaggctagctaacttttgaggattttggaggggagaagttatgaaaggaagaaatttaaacagcagaagtctagagtggtaattgcagggagggacatacgcaaggtcatatatatcgcaatcctcagaatgttctaaaacaagacctggcatttatgtttgtgttttctgtttattcttaataacactcaggttaggcaggaatgttaggctgtttgttactgcatctatggagcccatatttatgacttcttacctgcgagacatttcaatccatttcattgctatactctgcacctgagaaaaaaggcttccatgattttctctttagaatgtttcatcttttaaacacacatacatacatcattgttttgtttctttgttttgttttctgtgaacaatgattctgaaataagagcactttattttcagtcacataaatctacattattaaatgtttgtttacagcatttccagctcaccatccatggatgtgaagggcatttacaaacactagatgattcactgactttgggagaacatactaccagccaacttgaataattgttttagaactagactgtcctatatggcatccgatagtcacaagtgactattctaccatgaaataaaattaaatcaaatttaaaactctagtttctcagtcacactatctgtatttcaagggatcaatagtcacatttggacaatgggtactattttgaaaagctaatccctgctctattagtttcctgaaactgccataacaaatgacctcaaacagtgtggtttaaacaagattctttctttctctctcacagttctgtaggccagaaattcaagatcagtgtcacagcatgattggttccttttgaaagcttgaagggagaaactgttctgtgcctccttctcaatttatggtgatggctagtggttcttggcattccttggcttgtggccggatctctcctgtatctgcctccctcattgcatggtgtacttactgagtgtctgtatatccaatttttccttttctcataaagacaccagtcattcaatgcctggccactttaatccagtatgaactcactttaacttgactacatctgcaaagcccctatgtattaatccgttttcacattgctataaagaaatacctgagactgggtaatttaagcagaaaagaggtttaagtgtctcagggttctgcaggctgtacaggaagcatgacatcatctccttctggggaggcctcagggagcttttatttatggaggaaggcaaaagtgagagcaggcgtctcacatggcacgagcaggacaaagagagagagatgagggaggtgccacacgcttctaaataaccaggtctcatgagaactcactcactatacagtactggtgtgggggggattggtgctaagccatttatgagaaatctgcccccatgatccaatcacctcccaccaggccctatttccaacagtgggggttacaattcaacatgagatatgggcagggacacagagtgaaaccataccactctaatttcaaataaggtcattttctgaattattgcatgttagtgatggcagcggcagcccatctggagaggccgctataaagatgctgactgcagcagtggtggcaccgccagggctgtatgctccactgagctggcagaagccaggaacaagtgggagcccttcctccctccgagttggtggggtgggagagccaccctcctgggagcagctgcagccgcctagttgcagctgtggacctgatcatccttgcactctcaggggcccaggaagtctcctgtagccctgcaggctcagaagtgcctgctcccactgcttggcctctccccactcctggaatccactctgattttggagcaaagttgaggccaagcctgggcactgtcacaaaccggccaggtgtgtgcatgctcagggcagtgctgacatgccagcctcttgctgcttcagccacttctgaactttgggcaccgatgagcatgagagggaggccaaggaaggggctgagggtggctcagggtgggcctgcatgtgcccttcggcatgaactgcctgggcaccagggacaacatgactgatagtggctggacacagacaggctcctgggtggaaaggggtgggtcctcagtgaagccccaccttcaagccagagacagcctgaagcatggggtccaggctgtcagttccaggtggagtctgtagaccggagttccaggtggagtgctgtttctgggcccacccatggccacccatggaccaatcagcatgcactttctcccttctgagcgcataaaaaccccagactcagccagacttgaagagacaccgagactaccagctgtgggaaggagctgcccactgtgagtctcctctccactgagagctggacactcatcaggacaacttgcctgtggaaaggagctatcactttgggtcacctgagatctgttctgtcactcaatgaggctcctctctgctttgctcatgttcatgtccctcattcttcctggacgcaggacaggaactcaggatgtgccaaatggtgggactgaaagagctgtaacacaaacagaattgaagcacgccccactgcttgccacattgtgggtgacgagaaagagagaagaactgcagctcttcagggagcccagacctaggggttccctgatccagggctgtgacactttctttggggctctgtggttcctggcacctccaagcttctgggaaccaccaagttccccttatcctcatctagatgtgggtgcttacagtggaagcctcatacagtacatctgctgtagctgcagcctcacatggagccagcacctgtgccagcgcctggaacttcccaccctggcatggctagctgtgtgcagtggctggaactcgtgcttgctctcccacacaccccttgccactgtgctagtggctcgtcctttgcaggtgtgggatccaggctggtagtgccaactgagcacaccctgctgggccaagtgggcagaatgaggccagtgggtgtgagcaatactcaggtagaaggcatcaatggccacagaggtttccggctggtgaagcaacaccccaaagatcccgtgacattaggactggaaaatagatttctgggaaacccagttcaacccctaacaacatttctgagtcttttctttcctgactactcctggggaatatacagcttcatttggccctatgctttcaccctaggaaacgagtccaacacccattgcttagcatatggggaaaaaaaagtgtatttaaattggagagtaagcatacatttgtgatgattgtggaattcaaggaattggaacaaggtgaagcaaatattcagcttctcccatcagctctccttctctacatgaaagctaaaagcatttcatgcctatgcttatgccacgaagtaaatatctggccatgtcctccagagacacaggtattattgggctttccattcagcaacataattgtgggcattaagatgacttttcccccagccaagtctatgcctgattacaatttgaaagaggatggattcagttgaaacagatataaaattcaagtaactgttctgaagtaccatttgatagctttagatggtgatgggacgctttaatcaaagatgccacattgaactgtgggctaagatgcagggaataacttttacaacagtaattgcaggctctctagagtctgattgagatgctaaagagaaaagtcatggagaagtggcatttttatcagcatcaatgaaatgctaaggaatctatggctgcttatcagagttcctgacttatttaggggaatgcaagtgggaaaatgacaccttgctggacatgtaagatctattcagcgaagcaactctaggcttgaccaagaagaaagatgttattcctagactacaggatgcagaaagtctgggtggccaaatagggagcagataacatcttaggcttctgaaattcaaatttgcagtcaactgaatctgttgacacaatatccttttcatgttcaccctctgtcttagctttccacagctgctataacacagtaccacagactgggtgtctataaaaaattattattgtataataaattagaccattgattgcatcaatatctgctgtcttataataatttattatctgtttataataatttattataatataataaatgttataataaacattacatttattgtatgtgtataataagtattattacatttaatatatgtgtcttaaaataaattattatataataataaataagagagttcattgcattaatgcttgctcttataataataatttatttattatatgtctataataataatttattatgaatataacatttattataacatttgtcataaaaacttagataataagttatataataaattcatataatatatttataatagtaaattattatataataaattagttcattgcatcaatggctgcttcttataataataatttacttagtaatatctgtccataatagtcacttactattaatataataaattaatataataataaatattttaatataagtgtcttaaaataaattattattatatcataagttattatataataaattagatattaatagttcattgcatcaatgcctgctgtcctataataataattattatttatttatttattatatgtctataataataatttattataaatatgacatttattatatttgtctttaaataaattattaatatataataataaactatcatataaagatatacatttataatacattacataataaatcagttcattgcatcaatgcttgctttctcataataataatttacttagtattatctgtctataatagcttattaatgtaataaattattataatcaatattatatttactatatttgtcttaaaataaattattatttaataataaattattatttaataatagattattatataataaattagttcattccatcagtgcctgctgtcttataatatttattattaggcctataataatatattaatttgataaattattatacgtattataaatgtattatatttatgttaagttctggttatgcaataataaattgttatataataaattagatagttcattgtatcagtgcctgttaataatggacacttctattaatggggtgtcttataataataattattattgtttatttattataatatatttatgacaataatttattataagatacccagtctgtcccacacttctggacagtagacatctgaaaccagcatgttaaccaggcatatcctctctgtccaaaactttgcagagaatcctttcttgcctcttctgagcagatgttggtggtcattagtctttgacattgcttggcttgtggctgcctcagtcccatctctgcctccatctttatatggtcttcccctgtgtctcttcttataaggacatcaggaatagtgaattaggggcccacctgactccagtatgaccaaatcttaactaattacatctgcaaagaccctatttccaaaggaggtcactttctgaggttctgggggataggacttcaacatatcatttttgggaaaataatttgacacataacattctctatataaaacaatctgacacaatctttattaactttgaaggtgtgaactccaatatgactattctggcattcccaaatactgaagcccatatttactactctgttctcagaaaagcccatataacttaatatccagttaatttctaatcttctcctgtttgtttgttctttgatatcaaattcagatttcttttttgagacggagtttcactcttgttgccctggctggagtgcaatggcttcatctcggctcaccacaacctccgcctcccaggtccaagcaattctcctgcctcagcctcccaagtagctaggattacaggcatgtgccaccacgcctggctaattttgtatttttagtagagacggggtttctccatgttggtcaggctggtctcgaactcccgacctcaggtgatctgcccacctcggcctcccaaagtactgggattacaggcatgagccaccgcacccagcccagatttcttttttgttaacttttattttagattcacgggtacttatgcaggtttgttgcatatttcttaaaagaaagaaatattttataagggttccgtacttccctaaattctacaaaattcttagtctttaaccatattttaacaaccactcatataagccactcttctctctgttgcaggaaatgcagtaaaatacccttggcttagtgattcattgctccctggaaagtttgcgtatttgctttctcttttcattcacatgcggttttatttataaaggaccacagccatgtttttgaagtgcagtgaaaactctgctatggcctgaacttttcttttcccccaagatgcatatgtgatacctaatccccgatgtattagtattaggaggtggggcctttgggaggtgattgggtcatgagggtggagccctcatgaatgagattagttcctgtgagtggaaaccgcccccgccccaccacacaaacacaaattgtttttcctctgctctcacaccacaacaatcaacacagaagatgtcagtgaccaaatgtgtgggggcttctccccacacaccaagcaagcaagcaagccattgtgcagcacacaccagctggctgtcttccaattcagttctgacactctctacatggagacagcatcagatcccacagactgagggctcagtcccacaagactgctccctcttcccacgagttgcaagtctgggccttcagaacttctgattggccagcttcaagttggattctcatgactccctatgtagattggtttgatttgctggagtatctcatagacctctaaaacacaagtataccagtttattatcaaggatattaccagggacacaggtgaagagatgcatagaggaagatatgggggaaggggcacggagcttccatgctctcctgggttgcaccaccctcctggaaactccatgtgttcagctatccagaagctctccaaactcagtccttttgggtttttatggggacttcattagttaggcatgattgactaccatgtagaaatgtgattggacaaaagggttgtgatttaacactaatagactgagtaggggaacccagcgacgtctgtctgttcaaattcttcttgctgtgtctctacagcattccctcctcttgggtatggggcaggaccccttctgaaatgagggtcttatgccccacaatcacaaatccgaggaaaggcctggtgctgtggctcatgcccttaatcccagcattttgggagaccgaggtgagcagatcacttcagcctggagtttgagatcagcctgagcaagatggcaaaaccctgtctctacaaaaattacaaaaattagctgcgaatggtggtgtatgcctgtagccccaactacttgggaggctgaggtgggaggattgcttgagcccaggaggtggaggctgcagtgagccatgattgcgccaatgtactccagcctgggctacagagtgagactgtgtctcaaaaggaaaaaaaaaaaaaaaagaaaagtaaagaaaagaaacccaaggagaaaatagtttcctgccttgggttggggaaagtaaggcaggagaaagtcagggagagagattctgtcctccgagacttaaagcgccccaacattataacataggctatgggagctgagtcaagaaccatcaacaaaaacttatcatatacatgatagcacagtgccccttgaggaggaaaagagaacacagttctttttttttcagcatgtgcggacacagccggaaaacgtcatctaaatcaagaagcaaatcctccccagacgctgaatctgccacggcttgatcttgaactccagcttccagaactgcaagcaataaatgtctgttgtttagaagcaattcaatctgtgctattttgtgatagcagcttgaatggactaagacattcttggtgggaaaattctcaaatggggaagatgctaatatctcttcctgcttctgttctgttctatgagtgatgagtccaggctcaacctggcttcttcagcaggagtgccgcctagacattgggttgcctttagttgcttcctcaaagcatctggtcatagatctgtgtaaagaatcctggtcttgaatctgtgcatgatgcaatcagcatgagagtgaatacattgcccctctgcagaactgcagaatgtctgaagctgactcttacccttaattgtactctgacaagtatttattgtgcagctgacaaatacctaatgctgtgataactacaatgaaacacacctacatttatgttctgaactgtgctatcaaggagtttacatcttgggagagaggaatggagaagaaacagcattgtgttccaatagaagtcagaaagtttcacatccagacgctgttattacctggggagggatcgcgggcaggttctttaacccagaatactcttctatgtatattatgattctgagggctttcctaagcaaaacattctatgaatttacaatgaaacccatgaatagtgaggccgggatgtataaattggttttccgtggagtataatcaagtgtaaaaatatgtctgcaacagacaatagggatccctgcctgtgcttgaagtaccccctgctgattggaggtggccacatgctgcctgtgttgcaatctgcattttcaggagagaatacatctgctttgatatgatgggttagttagaacaaaactgacgatccttctgcctacggttctgtatatcatcctggatttttgagcccagtctgtaaaggaagtttgctactgatctcgtctgagccaagatgggggtagattttcccagtagctcagttatgaattccttctatgtatttcaggacatgtctgtcctgtgtcaacataataaggccttaattcaaaatagctgcttatcaaaagatgaaccacagaggtgggcacattacccttcatcccatatttcagagtgtatttgtagactgcgggtgaaaattggcttccagcatgtgagtttattatttagttcttgggctctggtgaatttaaacttggcgggaacaccaccagtggtgaaaggaggaacaatgacagccttcaagcagcaattcttgtcttcctttgatcttgtctgcttcatacctgcatatttattccagtttggtgattcaagaaatatgagtatctatattccagaaatagatttctttataaactctgttgtgtgggacccgtagccaagtcgtgggaatttgaactggggcagtccgcaaaaaaacacaatgatgttggaaagtaaaagtgaggaaatttctttacatgaaatgtgaagaccatgaaaggtgttacaaatatggatttgatgagcctcaaacctacaaatataagaagaatgatcaaggatgatacaggaaaaatacaaagtggtagctgtatgcaatccaaaacaatcaaaataatatgaaggaaagtagaattaagcattaggaatataaaatagagggtggatatcaacatgagatggctataaacctatcattaattaattatggagaaaatgaagttgttcctttgatatcttatatgcaaagctagtgaaatgctacccgggaacatttaaatcaggttttctcaaccttggcactattgaattttgggtggcatactgcatcgctgtaggggctgtcctgtgaagtgtgtttttcagcatctctggcacttatccactagatgccagtagcagcctccaagttgtaacaaccaaaagtgtctctacacactgccctgtttccctgtggtgtaatctccaatacgaatgagaatcactgctttagctgttttctgaggttcagcatgtttgaatatatggaaagaaagtgaattcgtgcccccagtgatgaagtgaccagggagaccatggggcaggaagtaattcatcaactaatttttcagtataggcaaaatgggtcgatttggggaaaagggatgcctgcttaaaaaacatgcatccacaataaagagaaaaatatggtctgtaacttttaagagattgatttatactccacttgggtagatggtagatatatatcagaacactgtacggttaaacctctcttattcattttggatttaaaagcacatgatttgtaaacagacttctagaatttaatctgatttctatccacttctacctacaaatctgaggagtgagaagactttttctggagatgatgtttatcagaccatgataaggagagcaaatagctgtgattaaccaagggccaacagttagctctgggaagaatggtcttggacgtaactattccaaccacaaataatacttgcttcattgtcataatattgggatattaattttctcttctttgagcacgctttttttttttttttaggcaggcatcccttttccccaaattgattcattttctctacactgaaacattcgttgatgaattacttcctgcccccgtggtctcacaattcaaatttctgcgctttggcctatgatgagaagtaagagttttcacttgtccatctgagaagccacatctcttcttgccattctgatttatgaaaatccccaacatgaagaagactaaactggctgggagacttcttactacgtgctgtttataaactgaggctgcaggcatttgagcataaggccactctgttcattttattgaatttatcggacttcccgagctcctacttttcatggtggaagcccagtcgtcatatcgcaggtggaaggaaaacattttatggacaggaataatgacttaaaatctgaacccagtgacctgcttgactcaagactggaggaaggtcagacacactttcttcttatttagcttctctgatcagcaaggctgacaggtcacttgtgaactgtggctcttacctagttgttacggcctggccacgtcaggaggttatgggggaagttaactataatcagcatcacttgtcttcgataaccacttaagagactttgagttttactttctggtacacagccggaaacttaattagtcttttatttgaaaacattataataaaattaagcaataaatgtgtcacaaatgactttgtaagttaaaaactaagaggttcttgaaaactttatgagaaggaagatggacaaaagtgggaaatgcagatatgtatctgaatccttaaatgtaggtgatgagggcagagtgatgagggcaggtaggtttgagtaaaatataagagattgtaataatataagtatattatagtcaaatgtaatactgcaaaatagtataacataataccatatataataatatagtataatataatataatgtaaattcaactatattgttaaaagctgatatcttggcaggcaattatctaggtactaaaggtaaaagaataaactagaaagacaaaaatctcatcgcacatcattagtataatacatactatatactatcattagtataatacatacaacatactatattattataatacagtatatagtacatattttatataatattatataattatatattattattatataatatatataaataatataataatatatagtataatgtagcataatatatagtatatatagcatatactctaccatattattatagtatatgctatatatactatactatatatactatactatggcaaaaccctgtctttacaaaaactatatactatattgtaatatatattatatattatatattatgctatatatgccatacagtgtacatagcatatactacataatatttagcaataatatgatcacctttgtaatcccagcactttgggaggcagaggctagagatagatatacattatattatatatatattatatattatatagtatatagtatatataatataatagcatatatgatatataatatattatatattatatataatatataacataatagtatatataatatataaatttataaataatatattattatttagtatatgctatgtatactatattataataatatagtataatatataggcttataataatatagtataatatatagtatattataataatatagtataatatatagtatattataataatatagtataatatatagtatattataataatatagtataatatatagtatattataataatatagtataatatatagtatattataataatatagtataatatatagtatattataataatatagtataatatatagtatattataataatatagtataatatatagtatattataataatatagcataatatatagtatattataataatatagtataatatagtataaatttggctatattgttaaatgctgatattttgacaggcaattatacaggcactaaagataaaagaataaagtaagaagacaaaaatctcatcactcaacattaacttctggatttcataagaaacaataaaagtagatatattaaatgattgactgccatatgctagaaagtgataaatgcacaaaagagaaaaagcaaagaaggataaaaggattttgagtgcagaagagcatagaattttgtaatatgaaataatgtcctctgcaattctttatgtctctaggagattttttgaattgtttgcttgaaacgcgtttgtttgtgagcagttcttgttgatgtttgcatgtactagatctgcactatatacaagaaatgcagagatgaacggacatctatacttttggcttttacagatgcacagtgtattttagctgttctattaggagacatcctgctacttttttttttttgagtcagggtcttgctctgttgctcaggctagagtgcagtgtcatgatagctcactgtaccctcaaacttccaggctcaagcaatcctcccacttcagcctcccaagtagctgggactatagatgcacacaaccatgcccagttaattttttatatatatagatatatatatatttttttttgtagagatgggagctcactttgtagtccaggctggtctcgaacttctggcttcaagcaattctctagcctctgcttcccaaagtgctgggattgcaagcataagccactgcgcccagccctctggctgcttttaatgctaataatgatatacaagagagcattccggacaagatggcacagcagtataagcactgacttactccccaccaccacacaagacacaaagcaagactaataaaatgcagaagattccattccagaaaaaatacactccaaaaagaaagaaagaaaggaagaaaggcattttagagagttggttggatgccctgggctttcttgactttggatcagaagacaggtagagggtgctggaggtctgttgatgtcgtggctaagttctaaatgtctttcaggacaaatagggaaaaaagccaggatgcagtgtaaaaccaatatctgtgatgaaaacggttctcacaaccctgagaaagggggcaaaaaatcaaaatagagtttgatttgaaaatagcatgaaaacattgtttcattctaagtgaaagaagccagacagaaaaggtcagatattacatgattccttttataaaaactctccagaataggtaaattcatacagtcaggaagaggtttggtggttgcctggataattgcctgtcaaaatatcagcattaaacaatatagtcaaatttatattatatcatattattataatatagtatacaggggctgagggagaggttattgggaagtggctacttaatgggctcagggttttcttttggggtgataaaaatattttggaactagacagaggtgattgtgcaacattgtaaatgttctaaatgtcactgaactatacactttaaaatatttaattttatgacagtgagtttcacctcaaaaataattttgaaaaaggaggcaaacacatcttttttgagctgcacaggtgctacgattttaagcatgacgtgatgctacagagagaggaaaatcaaaaaccagcttcacaatgaggactcaaagaaaagtgtgctgtgtggaaggctgaaagtgagacactgcaactgcgatgtcattacaagacgtggtttttgctcttttttatggctgtgtagtattccatggtgtatgtgcaccacattttctttatccaatccgcctttgatgggcatctaggttgattccatgtctttgctatcctgtcctttgcagcaccatggatggagctggaggccagggtgcgtctccatgtgcaggtttcttagacccctgaaactgaaataaaattacaaaaaaagacctggttttcgacctggagtgggtgggcaggggcaaccacattaggcaagcatggagatggggaatacaaattgagctgtccatgttctcacttataagtgggagctaaacattgagtacatatggaaaaaaagaggggaacaacagatgctggggactagttgagggtggagggaggaagaagggtaagaataaaaaaatgcctattgagtactatacttattacctgggtcatgaaataatctgtacatcaagcccctgtgacactcaatttacctatctaagaaattcttacccttcttcctctcctcaactagtctggcaacttcacatgggaagtggtttggggctcagctgaaggaacatgaaagaggcttttataggatgaaggcaggagcggagcattaaaaaaaatgtgattggttaaagctgaagcattgaccttatttggactatctctgtagaaagtttgagacaatataaccagtgctcagctggccatttatgactggctgagctaaagttttgttttcctataaattagccacttagaggaaatgaacaattacaacaaatatataaatctacatctgacaaattatgaaaagaaatgtctaaatccacgtctgacctagaaaatttccaaatgaaggatgaaagcttttggtttgcttccatagaacctagtgcatcagaaccatttcagtttaataacctctcatttagctgttttaatactccccatcaacacaaaacagtgaataagaaatgcaaagtctataaataaatataattctaggaatgacagcatcaaaaatcagtgttgagacctaaaataactcaaggcaaagagatcttcttattaaaaatattgaagaagtccttaagtatatttataatagtcaaaataataaagaccagcactttgggaggtggaggggagcagatcacctgaggtcaggagttcgaggccagcctggccaacacggtgaaaccccgtctctactaaaagtacaaaaattagttgggtgtggtggcagatgcctgcaatcccaggtactcgggaggttgaggcatgagaattgcttgaacctgggaggtggaggttgcagtgagccgagattacaccactgcactccagcctgggtgacacagcgagactccatctcaaaaaaataaaaacaaaataataataataataataataataatagagaaatgttatccactaaaaagatatatatgaaatcaaaacttgattaaattaagcagaactgatggttatggaaattcttgtgaagtaaaaatgcagtcatttatataaaaccatatatatattcaaaacaaattctacatcagatataactgaagcaaaaactagtgaattagaagatattcctaagaaagagactcaagggataccacaaaaaagacacagaagttaaaatatgaaacagtgaattcaagaaatggtgaggaaattgagtttccatgatctatataaatatttgaaatttccaaaatgatgaaatgaatgtgacaaggcaatgtttagaaatataattactaataatcttctagaattgaagaaaggtccaaaattcagattaaaagtgaaatgagtcaggaacaaagtttaaacgctgcatgttcgcactcatatgtggaagctaaaaaaagttgctctcatagaagtggaaagtagaagagatgatagtgaggccaggagggtagggggacgaagggaattgggagagatttgttgaagaatacaaaactacatccagataggaggaataagttctagtgttctataccacagcagggtgactatagttaacaatcatatattatgtagttccaaatagttacaaggatgttttcaacacaaagaataatcaataaattttgagatgatggatttgctaattatcctagactaatcactagacgttgtatgtatcaaaacatcactgtgtgccccagaaacatgtacaattattatatgtcaatttttaaaagtattcagcagttttcaaataggtaaattcacatgtagagattatgtggtgaaactgtagattaagacaaaataaagactcatttatgtatatatatataatatatgtatatatgttatatatatgtatatataggaatttaacatgatctttaataaaagactaaattatttgaatatataacttatagaaaagataaatttctgtaatttcatataattgtggaattctccatatggagagaagaatatgagaaacaatgacatgtctataagtttataaaatatatcttagaatttaataaagtttcaaatacagaatgggccaccttttgagttgtaagaacaatggagagttccatcattcgttagttatcgtaagagatccataatagtcaagagtattctagaaataacttatttacatgatattaaaatcatatccatttcaatatttacaataaaatgtaatggtacctgccaaaagaataaaaataaaacatatagattccaaagaagcaggaaagaaaaaaagcaacaacaaaaaattaatccaaaagaaagaagagtagtaggaagaaaaggagaagcaaaaagagagtaaaaaacacaaaataaaaataatcgttagaaattattcaaagtaatgaataattagcacatggctgtatgtgtgtgtctgtgtgtttgcatgtggtgtgtgtttgcatgtatgtgtgtgttcatatgtattatattcacctattcgaaagtaaagattgacaagttgaattcaaattcttcagaaatatgttgcacacaggaggagcacacacagaaatgccacctagaaaatatccaactgaaggatgaaaaaacctctgtgttgcgtgaactataaaatgctggttaagatttgaagaaaattctctctcttacactgctgagagaagcaaaaattcgtatgacccattggggaataattgagcaatgtctagtgaattttctatgcctatgccttaagccttttgaatgtttacataaagtgctatataaaaggaaagtcagtgtagcgctgtctgtaatagtaaacgattggaagtaatccaagtgcagggtggcacaacaaaattataccagttatatttactttaaaacctgctaaatagtgctattgattactaccagatacatgcataagtaacagtatttaaaaaaaattctgtgttcaagatgaacaacaaaattacagtaagctgtacttttaaaaataaaaacaaagcagaattggatcagatgattgtttacagagaactttacctttttacacacacacacacacacacacacacacacacacaatcaacaaggggaaaataaaaaggattgagaaggaaagaaaagcaagacagtctgactaagaaatgaataaatataatcttgggtgatggtcatacaccttggcaggtttcctatgtctggtttgaaagcaaagccaattcagagtgcatgactttactatgatatagtccaatgtagaacagaggtaagctcttttggacatttcttggatctctgtaagcctgggcatgcaccttgctaaggcaagccaggaatgtggaatttttggatgtttctcttttcagtcattaaaatcctaaggaaacagaattaactatgaagtgtggctgattggtttttgtttgaagatactgattctaaatatcttcctttatggatgtaataagccctgatctaatttaattggtgaaagagaacagatttcttaagcttgttaggtaattatggccataatatatctaaaatatacaaagaaaataaaattcaagaggaaattggtttggaaaggctgttggaaaaaatgtgactggtacatatggataataccttttacaggaagatcacctggaaaaaacacaaacaaaagtgcaatgtgggccaggtgtggtgactcatgcctgtaatctcagcactttgggaggccgaggcaggcggatcacctgaggtcaggagttcgagaccagcctgaccaacatggtgaaaccccatctctactaaagaatacaaaaatttgccgggcatggtggtgggcgcctgtaatcccagctactcaggaggctaaggcagaagaatcgtttgaacctgggaggtggaggttgcagtgagccgagatcacgccaccacactccagcctgggtgacaagagtgaaactctgtctcaaaaaaaaaaaaaaaaaaagctcaatgtgacaagggagaaaaaattattttacagtaaaggaaataaaattaatttaaaactggaaacactgcaactctacagtgatcgcaaaaacgaaaacaaaacttgctctctatgagctggggagtaaagtgagacattccaatcattgctggtaggaggggtaaaatgctattattatttttgaaaaaaatggtatggcaaggaataagcattaattgctgtaaaaagtgctatgaaatatagcctaaaggaagcatacagaatgcaaaataaatttcattattcacaaatatatttattgctgattaaaataataataataaaaacccacattgaaaataatatgagtgagagaactgtgatccatcattactgaatgtgatttttttccaactttattctgagtttctggccaggttggctagagtgtttttctgcaagaaagagataatttaaattctttttatttttaaattatagactattgaatatacatgaaattagagataataatatgatgagatcccatgaatcactcagttttagtgattaaccttttcttggacatcttattattatcattatttttaccccagactctctcacttctgacaatttccggcattgtagtatttgaaacaaagcccaggcataacatcatttcatctgtaaacggttcatctgctaatatgtcagtatagcttttttttctcttttttttaaatttcaatttttgttggagtacaggtggtgtttggttacatggataccttctttggtggtaatttctgagatttttggtgcacctgtcacctgagcagtgtacactgtacccaatatgtagtcttttatccctcgccccctcccactcttcccccgagtccctgaagttcattgtatcgttcttatgcccttatatcatcatagcttagctcccacttataagtgagaacatatcaatgtttggttttcctattcctgagctactttacttagaataacggcctctagctccatccaaattgctgcaaaagacattatttcatccctttttatggctgagtagtattccatggtgtatatgtaccacattttgtctacccactcattggttgatgggcacttaggttggttccctattgcaaattttgctgctataaacacgtgtgttcaagtgtctttttcatataatgacttattttccactgggtaaatacccaggagtgggattgatggatctaatggtagatctacttttagttctttaaggaatgttcatcctattttccatagcggttgtaacagtttacattcccacttgcagtgtaaaagtgttcccttttcccatcagtgttatttctaatgaatagctctgtatataacacaacctctgtaccatggtcccagctgaaataagtcttacccctccatagttatagttttcagagaggacagagacttagaaggtggtgaatctgctatgaagacttgaccacacaggatctggggccaatgaatctcctggattctttgctaagctctatctggggtggaggcagctctgttcattccctgttcctctctctaagactgtggactttctcaaagacaattcctttccagagtctgagtgccagaggtaaaaccatttggcaaagcctgcccttctagaaattgccctccttgaagcttggcatggtggtgtacacctgtgatcccagatactcaggaagctgaggtgggagaatcacctgaacctaggaggtcaaggctgcagtgagacatgaacacaccactgcactccagcctgggtgacaaagtgagatcttgtctcaaaaaaaaaaaaaaaaatagattgctttccttgtattattgttcaacacataacagtttaaaaacttaaatcaaagcacaatagaatgagaataatgtaaatggtgcacacagcttaagaaagccatcaattcctagacgcactgtccacagtttgggtttaatttggtaaaacaacaacaacaaataaaaacaaaaaacaaaaaaaaccctcaagaatgtcttgttgttgatgctcaggctggcaggagacattctgcttgaggttttaaagaaaatgggcatcagtgatgtttgcccaagcagctacctaaagaaatatagggagagattggataaaggatacaaaactacagttagatagaatgaataagttctggtgttctataccaggagtcaggaacaggccacacagcagccagtaaaactttatctgtctttacggccactccccattgctcacattactgcctgagatccgcctcctgtcagatcagtaaccacattagagtctcataggagtgcgaaccatattgtgaactgcacatgcaagggatctagtttgcacactccttatgagaatctaatgcctgatgatctgtcactgtctcccatcaccctccagatgggaccatctagttgcaggaaaacaagctcagggctcccactgattccacatgatggtgagttgtacaattattttattatacattacaatataataataaaaataaagtgcacagcaaatgtaatgtgcttgaatccccaaactatcaatccccaaactctctctcccatccccactgtccaccccaacccctcaacaccctggtctgtggaaaaattgtcttccatgaaaccagtccctgtgccaaaaaggttgtgaactgctgttctataccactgtgggatgactatggttaacaataatatgttatatagtttgaaataactagaaggaattttcccaatacaaagaaatgataaatgagatgatggatatgccaattacctgatatgatcactgtacaacataggtatcaaaacatcactattaccccataaacacatccaatttttatatgtcaattttagaaatttaaaagtttaaaaaaagagagagaaaaagacactactttgtttttcttgcagttccatgtctaattcccattttattccaaccagtttggcagtcttcttctgtcacagtttatatagggatgtcagcagattcttagaataactacttaaaattgtttaatcatcccttttaaaatacaagcaattcaattgctatttttatttagatctgtaattgctacaaggcatttagagttctgatgtgtagatgtagttacacgttttgccttctccagctagaacactagagggcataagaccaggaagattgactggcgccaacatgtgagggagatggctacttggccttggctgagagctatgaaagggagagagacagagaaagttggtaagaataaattatccgaggctttgagctgggaggtgacgttgtcaagatagtattttagaatcatacagggcaaaggtctgcctgtttcttttcctagtctcaggaaaaggttaacaagatatccatcaaagaaagaaatagaacattaacacaattgccttttgttttgtatttaaaatcttagccttcttgttttagactaaagtaatgatcaggtttaaacaaataaatcatgaccattgtattgaaagaggatcttccttccttccttccttccttccttccttccttccttctttctttctttctttctttctttctttctttctttctttctttctttctttctttctttctttctctttctttccttctttctttccttccttcctaccttcctccctcccttctccttccttcctttcctcatttttccttccttcctccttttttcctccttcctttctttctttctctctctctctctttttctttatcaacagaggataaggataagggataaagagaatagagaattcaagtaaatctaaaaattgcacagtgaaggggttgaaagccccttgatacaaagttctcattaccatcacaggtacttcaaagttaaaaaaagaaaaaagaaaagaagtccagacacaatgcctcccagaagattcaatttaggtgcattaatatttcaaggtatgtcttttaaggagtaagatgtgagcatgagtatggtcgtgtcgcctgttgtttgttaatacacaatggattgcttaccttgcgtctttgaaaaatgctgactgctttttcaaaactcactgcccctctatgggattttaaaatcttccggtagaatatcaaagcattcacgatctcatttctttttttaaaaaaatcataataatgaacattcatataacactctgcatggcatattactttattgtaagcattttgtgaaataagtcataaaatgtgagaattttagattaggaaataaatgtatcttaaatttattctactcacttaaatttttgtaaacattaagtggccacatagagatcaacaagcagggatttttcatcacaccagggagggtattgatcatcccttcaaataaaggaattcttagtgcttttttgtggttttcttttggattgtatggaattgcccttctcaacctggagaagtgttgaaaatgatcatctggtcttcgttttttctcctctatctgtaaaactcgacttaaaaagaacttagttaaagactttctgctactgtggacaaattgcaaattaattagccaaaaggagacttctagtatcaagtgagatgagaacacaacagtttttattacttgggacagcatttagaatggctgatagcagccgacactggcgggaccaccatccctgggatgtccttgacttattggcaactgccaaaacacagcagatattgcatagacattgtccttaccaagctgggagtctccacttaattttacagcatttacagagaaccacctgagtttacagcctaagaaaattggagttcattcagtccacagagtctttcacttgaatgtgcacaaagctcacatagtggttttgttaaaatgcacattccgactcagcagaggttgtgagtttcttacaaggtttttgggctgctgatattgacttgtctgacgaccacacatggagtcatgagattccatgctagagccttttcactgtacactggaaggatctcatctgcagagcagatggtccatggaaggcagccagtgcttgcttcattgggcagcagtcgtccccatgtctgacaattgtccctatgtctctgaccattgaacttgctactctgactttcaaatatgaatgagcctgctcactgtgatcatggtgaagatataggtggtaaagattatagagggtaaagatataaacatatacatatatgcacatatatgtgtgcatatatatcacaatatattataagaaatatatgtattacagttgatccttgaacacaacatgggttagaactgtgtacatcaacttaggctgatgggttgtcttcagcctctgccacccctgaagacagcaaaacaaacccctcctcttcttccttctcaatttggagatgatgaagaggaagacctttacgataatccagttcctcttaatgaacagtaaagatattttctcttcctcatgattttcttaatgacattttcttttctctagcttactttggtgtaagaacacagtagactgtacatgtaacacataaaatatgtgtgaatccactgtttatgttactggtaaggcttccagtcaacaaaagactatcagtatttaagttttggggaagttaaaagttatattcagggcctggcacagtagctcacacttgtaatcccagcactttgggaggccaaggcaggtggataacctgaggtcaggaggtcaggaccagcctggccaacatggtgaatccctgtctctactaaaaatacaaaattagccaggtatggtggcacatacctataatcccagctacttgggaggctgaggcaggagaattgcatgaacccgggaggtggactttgcggtgagccaagattgcgccactgtactccagcctgggcaacagagcaagacccggtctcaaaaaaaagttatattcagatttttgactacatgaggggttggtgtccctagcctacatgttcaaaggtcaactgtatatctattatattttatatgcacacatgtagacgtgcattcatatatgtacatataaataatatatcacaatatgttaatagaaatgggtatgtagtatattgattatatatatgttatgtatactctatcatgcatctacctatgcaacaaggaataagtgattacagctgctatctgacttagtttttaacttctctctttcttgtctgcgtggcttgaggaattttcttataagctacttttcattctccaattacactaattccctttacggcccaaaagagcaaaaagaaaatagatttttaaaccctttgtttcgttttgctaaaggttgtggctgccttttatttttatagtgagattatctgtagtcattttcagtcaacttcagcatagtcagtaagtgagaaactagtagttctcaaacatgtcatttcatgtaatcatacggaacatgaatatagaagaattttattttggagaaagatgtttctggcaaggtctgtctctttcaggtagcttgtatactgaatgtgaattgttacctttttcttcattttgtttgtttgtttgtttggttttttttttttgacatggagtcttgctctgtcacccaggctggagtgcagtggtgtgatcttgcctgtctgcagcctccgcctcccaacttcaagtgattctcctgcctcaaccttctgagtagctgggattacaggcgcctgccaccacacccaactaaattttgtattttcagtagaggcagggtttcactgtgttggccaggctgtttttgaattcctgaactcaagtgatctgcctgcctcagtctcccaaagtgctgggattacaggtgcaagccaacacgccccgcctaccttttcatatgtctgtgaacacacttggaatgcagatgccaaatcaacccttttgcatcaagaaaatgcagtttaacctcgactgttttgaaaactgggaagctactgttaatatctttgctaaccttatatcccagcttcttgctttgagaaattataaggatctatttttattaagtattaaatgttagaaatctaggaaccatgtgctttgaaataaagtttactatagtgatggtgattttctccccatctaatatttgatcctacaggttgacttcatgttactaatcactttcctcttaggtgttgctagtcacactctgacaccactgtccccctaaaaggggaaagtgattttaattatgatcaaacttccttacaaattggaaagacgtgtatcgtccccaaacagacaccaacctggtcatctgaatcatgtggatctaaccagcacatctgttcttaaaaggaagatggtatgatttgatattctttttttttttttttttctcattttgatctatggccttgcagagcaattctgtccaggggacccttccaccacagtgtggatgcttttcacctgtgccatcaaatatggcattgctagatgtctgtggttattaagcatttaagtgtgactactgcagatgtgtgggttttaatttaatcatttaatagtgactaaatattcataacaaaatataccctcttaaccattttaaaaattttgcataaatttaaaaggtacatgtattagtccattttcatactgctgtgaagaaatacctgaagactaggaaatttataaagaaaaagaggtttaatggactcacagttccacattgcaggggaggcctcacaatcatggtggaaagcaaaggaggaacataggcatggcggcaggcaagagagcttgtgcaggggaactcccctttataaaaccatcaggtctagtgagacttactcattaacatgagaacagcatgggaaaacccgcccccacaatgaggtccctcccatgactcatggggattattggagctacagttcatgagatttgggtggggacagagccaaaccatgtcagtacaagtgcagcttttttacatggatatattgcatggggtaaagttgggactttgagtgaattcatcacctgaatagtttaccttgtacccaatagctaacttctcatccctcacccttctccaccctcccagccttccaagtctccaatgtctactattccactctccgtgtccacatggatacattatttagctcccacttatgtgggtgaacatgcagtattagtatatgactttctgtttctgagttattttccttaagataatggcctccagttccatccatgttgctgcaaaagacatgatttcattcttttttatggttgcatagtattccatggtgtacatgtaccacagtttcttcatccagtcatccactgatggacacttaggtctttgctactgtgaatagagctgtgatgcacgtaaaactgcaaccattaagtacattcacattgttatgcaactatcaccacccttcatctccagaactttttttgtcttctcaaactgaaactctgtccccattaaacactaactccccagactcctctttcttctgcccctggcaaccacctttctactttctatctctatgaatttgactgctttatgtgcctcatataagtgaaatcatatggtacagtcatccatttaacaataagaatacttcctgagaaatgtaccattaggcaattttgtctttgcgggaacatcagagagtgcacttacacaaacctaggtggtacagcctgctacacacctacattatatggtagagcctgttgctcctgggctacaaacctgtgtggaatcttactatactggatacagtaggcaattgtaacacaatggtaaagtgattatgtatcaacacatacctaagcatagaaaaggtacagtaaaagtatgacataatcttatgagaccaccattgtatatgcaatctgtcattgactgaaatatatttttgtggtgcaaagtggtgtttttctttcattgtgactggtttcttgagcacaatgttttcttttctttcttttcttttctttttttcttttctttgagacagggtctcactctgctacgcatgctggagtgcagtggtgccatcatgggccactgcagccttaatctcctgggctcaattaatccttttgcctcagcctcccaagtagctgagaccacagacatgcacccacatgcccggctaatttttgtatttcttatagagacagagttttgccatgttgcccaggctggtctagaactcttgagctcaagcaatcctcctgccttagccttccaaattgctaggattataggcatgagccatcatgccaggatgagcacaatgttttcaaggttaatccatgttgtagcatgtgttagaatttcttttttctttttaaggctgaataatattccattgaatggatataccacattttgtttatccattcatctgtcaatggttgtttctacactttgactattatgaacaatgttgccatgaacatgtttgaatccctgctttcaattcttttgggtatatattccagaagtgaaattgctggatcatacactaattctatgtttaattttttgaggaaaaagttatttttttctattttactattttccatagcagctgcaccattttatattctcagaaggaactgaattgttcattgcaatttaaatttaaatagccacattggctgatggccttggtattggacaccattgtcatagatgaccaaagtgaaacttaaaaatttatttgccctgatgattggtagatgaaacagattggaatcttcagcaatagcagtcataatcatgggatattttgctccaaaagtattagaattcattggtcaatcttctattttgcatttaccaaatataaaagcctttcttgaagtttaaggtgtctaggtataaaaacattttaatttgagtaagctaatattgattgcttgtctaaaatttgcactcacaccatatcaaattgaatgtaggaataaatgagtgtgttgcacataagtctttgtgataccactatatatggggacttcctgcaggggtacatttgaaaatttaaaggatgcatgttgtgtaaatgactcaaagctccataggccctggggaaggtagggagagaaccccattgtgtctcttgcttctgttttgtgataggtttagcccatgctggtttgcctccctctcagacattttaataaactcaacatacacaattatttctctccatatcaatgggaggaaaacaccagctatgattgcaatgagctttagaagaacatcctcctcagagcactagagcatttgagtttgctaaactgaagaataaccaacatggattagagtgtatagaactccagaggacaaaaaacttgctcatatagccagcacttggatcaaaacatgggcattttaacgactctataatgctccctcttaaccacccatttttgttcaatgatccatgcccaatatggtaataataatgtctattctgatgcctgtcacacattaacctctcctctgatatctactactgtggatttattcaacttctttctttgtagcagtaactattgctgtgtaacaaaatcccccatccttggtggtttaaaataaccatttggttatgcacacaaattctgtggggtgggaatctggacagagtatggggaggatggcatgtctctgctccacgaagtctgaggctgtcagttctcagctaggaaaactcaaagactgaggttgactttacaagtaggagtagtgcgatcagagagtttcatttacttctatttctaacccttgtgttgagatgacttgtgatttggacaactcatcagagagcttacacaaggtctctcgagggatggatgcttcccagcagaatggacttaggatgtttcatgtggtggctcagggctccaggtacaaatattccaggggcaaggagagcatcactatattcatttcttaggactgctgtaataaattgccacccattgaatgacttttaacaacagaattttattttctcagagttctggtggcaagaagtctgaaatcaagaggtttcaaggccacactccttccatgggctctaggggaggatctttctgtctctcccagctcctgcggggtccaggaatccctgggcttgtggccgcatctctccagtctctgcttccatctcctcgtggcctctgtgtctgtgtcttcttctcttttgtctcttagaaggacatctgtcattgaatgtagggttctcacagataatccaggataatttcatcttgagattcttagttacatctgcaaagaccctatttccaaataagcacacatttacaggttctttgtagatgttagcacatggacacacctatttggaagacacaaacacaattctactcacttccaccatcttcccttggctggatctgctacatgccagtccagattccagcagaggagaattatacgccaccctgtgatggggttggcgaagtcacattggagaagacattataggacagaagagaatgtgtggcccatttctaaaacacaacctgctgtagctgtgatcatctcaacatttgaccttgatcaacatcaactgtgctagcacgatctgcgaatgaatggcatggtgcttgctatggcctcaatgtttaaatcccttaaaattcctaagttgaaatcctaaccccaaaggtgactgtgttcagaggtggggctttttggaggtggagaggccatgaaggtaaagccttttatagttctcttataaaagggaccccagagagctcccttgccccttcctccatgtgaggacacagtacgaaggtgctgtctatgaatcaggaagcgggtccccactagacactgaatctgccatgtcttgatcttagactcccagcctctaagactgtaagcaataaatttctcttgttcataagcctaccagtctatgatattttcttatagcatcctgaacagactaagactgaattacctctgctttttcttaaggttggcatttcctgactacttttaaagcaaacaaaaattgtgattgcttgcattccttggtcacttctttgcttggaggtaaaaatattctattagcttttcaacaggctgcgttttctaatggaggtgtttcattgtggctattcgtgtatgcttctgattcctcgttataatattgcttctttcacactgagatactcagcaacttgaaaggtgaaatataatctcacacacacacacacacacacacacacacccatccggtctttatttatacatacaaatacgtttacatatacacacagagagagacagactttttaacctattcatagttaacaaatattttaacacacacacacagagacagagagagatcttcatctatttatagctacaaatatatttacacaaacagagagacagagaaaaagagagatcttcatctatttatacttacaagtgtttacacatacacacacagagatttatatctattgatacttacagatatgtttacacacagagagagacacagagagagagagatagggagatcatcatttatttatactcacaaatatgtttacaaacacagagagagacagagagagaactattttaatctatttatacttacagatatgttacacacagagaaaatgaggcagagacattttcatgtattcatacttacaaatatgtttacccccccccacacacacagagacagagagagagatcttcatctatttatacttaaaaatgtttacacacacagaaagacacacagagagagattttcatctatttatacttacagatgtttacacagagagacagagagagattattatctatttatactcacaaatatgtttacatagaaagagagagacagagagattttcatctatttatacttacagatatgtttacacacagagagaaagagacagagagattttcatatattcatgcttacagatatgtttacacagagagagagaaaaagagagattctcatctatttatactgacaaatatgtttacacagggagagagatggagagggagagagatctagatttatacttacaaatgtgtttatacacacagagacagagagagacagagaaatagtcatctatttatacttacaaatatgtttgcatacacacacgtgcgcgcgcgtgcacacacacacacacacacacacatatatatatagagagagagagagaaaagagagacagagattgacaatgctctatcctgagaagtttgccttgagagtaccccttctgcattttgtcaatgttcatttcagtgttagtgtggagaattcgacagagcataactgacttgaagaccattgccacattttaataatatggtgaagagaactcatccagctgatcaaatagtaggaacacccatttaagaggcagaagaatcccctgagtcaacaaatccgtatggagaaagctgtcttttgagagccctctgcattaaaattttgtgtgagtgaagataaatacagccagcctttcactaacttacaggttaccctctccagtgctttccagtcctggcccttgtcttaaatgacccaacaaatatcagaaccaaagatgatttgctctccacatgcaaacttctctagaggatgctggctctaagagcgctttattttcatacttgctcctattttgtcagagagtgggaatctgggagttgccttttccattccaccccactcaagttcagcagttgcccttttgttctttgtaggaagagaaaattaaatcaattgctggtgcaggtgtgtagaaatcgtctctggtttgcacagactgtgggagagaggagaggaacatcagccatggctttcaagttaattcttgatatgttggtgaagggttggtcgtaactttttgaattcatttttcagaattatgaagtaccacagactgggtgtcaggaataacaaaaatgcattctctcataattctggggtctagaagtctgaaatcaaagtgctagcatggttggcttcttctgtaaactccaggagaatccatttcatgcccctatcctatttttatgtggttggtggcagttggtgttctttacctggtagacacactatgcctatctctgcctccgtcttatggtgtttttcccgcgtgcatgcaagtgtttacattcttatagggacaccagtcatattggatcagggagccaccctactccaatggaacctcatctttaactaaagatatctgcacagaccctatttccaagtaagttcacattcacaggtattgtgggttaggacttggacatatctgttggagttgcacaactcaagctgcaacactttcttaataggttcttgcaaacaccaaggaagttacgcatttatctaatacattttagcagtacttccagggattcttagatgtgtagtagagaagatagcctcactaggggccctgcttggggaagttggactttcagaggctgagaaaagctggaggaagaactgtccctcacttggtgatgtggtttggctctgtgtccccacccaaatctcttcttgaattgtaattcccacgtgttgaaaaagggacctatgatacccacgtgtcaagggaggaaggtgattggatcgtggggatggttttccccatgctgtttttgtgatagtgagtgagttctcatggggtctgatggttttataagcatctggcatttctcctgcttgcacatctctctccttctgccatgcgaagaaggtccttgcttcttcttcaccttcctccatgattgtaagtttcctgaggcctccccagccaggcagatctgtgagtcaattaaacctctttcctttataaattacacagtctcaggtatttctttatagcaatgtgagaacaaactaatccacttggaaaacacacacatctcagaattcagggtgcacatttaatatttaaacattggtctacttttgttccttccctttgtctacccagggcctttgtctcattgagcagatttcttctctccaggtgcattttgctttctccgtatttacatttcatcaaagttagcagatcattactcagtttctctcaagatctgccatctgagctacctgcctcctggcagcataaattcttctttagagggcaatcagctcggttttctttctattggtactgcacacccttgagtttctaccatgagtttccttttatgctagatactgccttggatttggcattttttttttcatatgaagaagaagagcacatcctagagcaaatacattttggaaataattagacagcaaaattgtcatcgtggtaaaaccaatttaattttttttctaaagagtagagtacatcacaccagtgagttatctgtcaaagggtttatttattcaactctaccctcagtgaccttgaaacacttagagaacatacaggcatgaaatcataagtgtctccactgtcaaaagatttctaacagatgctaactaggactgttaactgcttacttataggaacttgtaggtgatgtcgtcgtcctaaatttaaataattagcaacactgattcttccacaaagctgtgatcaaatccacctactcctaacttctccctgctactgttccccagaacactacattcttcaactgtgaagtgtgtgtgtgtgtgtgtgtgtgtgtctttgggtgtgtgtgtgttgagttgaattgtgtcctgcaaatagatatattgaagtcttaacccctggtgcctccgaatgtgacagtttttgaaaaaagagtctttatggatgtattcaagttaagatgaggtcacttaaaaaagcacgtttttgtagaaacagtctaggcaggctaatacaactttttcgcttagtaatttagtaactattctgaacattaaaattccagatgccagcctagagtcagtcccagaagcaagtcattctaaagataataaccttaaacttatttctttaatgatttcttcaacaaacctgggtttgaggcactactctactttctctcatcatcttttatttattattcttagcgaggcatgtgagagagtgaataaaatcatagatcactgaaatatcaatgggcatgaggaagacttgagtccctttcagctgccaggctcagaaactccaattccaattaccatcaataatttaaaatctgaatgctcacatgcatggaagcagctcaggctcaacgatgcctgtaatgttggcagttctttctaacctttctctctgacctcttggatgttggtttccagatgtgtcttaccaagatggtagccacaaatggaatagcacaaactttctctgtcatactccagacagaaatgataaaggtgtctcttccttaggagtgtggatatatttcatagcatcactccagcagcccttttgtctcatatttttggatagaatttaatcccaatcccatttttaaatcaaacaatggcagcatcgccataattggcttggacaaatcctaatctctcttcccctccatccttcctcgggataggaatggatttcatttatatgaagcacttgtgcttaatcaatgtataaaattggggttctgttaggaaggagaaacgagaggaggatgctttgtaagacaccaaaatgtcaacaacaataagtctgtaggggaactcatctttgcattactcttgagacgagccctgggatagatttattgatcatgcactcaataatttgcttaaatcagaaacagattcaaggttatttgcatttttaaatcagctctctactgagttctttaaggaattcctcacacctcttggatataacaagagactcacataattggggaactccttttaaggcaccagaattatacacctgtgtcttttatatgtaaccaatttctcttttgaggagtagacttaagtaatgatgccacttcagtaagccctcaaaacttttctttaatcaatatcctctatgccctaggagcaagcattccttttcagagctttttcttatttttgagtctcacattatattgatttatataggctttcaaattccattattttatcctccaactgtaaagagtttgtgctaaggccaatgtttctttgtaagaatgttatggaggcaaatatatcatttcagcttattcacttcattccactgtctttaagaaaatatcatttctccttaccttcttagtgtcaagaaaagaaagtcaagctctttcactgaaacaagttttgacgtgtgcaaagagggccaattaaaattttacttaagaattaatatttttttccaaaaaattaacacttatgtatttgttatttttgtaagtaacattatatatttcaaacggaactgacttcttgcctaaacatttttaaaggaaaacaggagattataaaaaccacaaatcacttataattacatcaacatagaatgaaaggtgtgaaccatttggcatgtatatttttgttgtttcatttttctctcttctccatttttacctggtatacagaaagaactctagggaagtattaatttacaatacaactcatcaattataatgcaatagatagatagatatgtaggtagatagatagttgaccgttgaacaacatgaatttgaagagcatgggctcacttatgcatagatttccttctgcctctgccaccccttagacagcaagactaacgcctcctcttcctcctcctcctcagcctcctcaacgtgaagacaacagagatgaagacctttatgaggatccacttccactcaataaatagtaaatatattttgtcttccttataattttctttaacgttttatttttgctagcttactttattgtaagaatacagtatatatagtatataatgcatatcacatacaaaatatgagttaatctgctgtatatgtcattagtaaggctttgagtcaacagtagtccattaatagttaagttttggggagttgaatgttgtacatggatttttgagtgcacaagaggtcaatgtctctaacaacgatgttggccaactgtcttttatttacaatataattatatatattaatacatatataattatatatatacacacaatacatataatgtgtgggtatacacacacacacacacacacacacacacacacacacacacaatgcatctccagaaataatatatattggtggagtgagaattttagatcataattcagagggtgttgattctccacatagacgtttctttccagattccaggtgcacatgaattttggggtgagatcacacaacccataacgcctctgagctgtttattgtgtagagaacacagcaaaaacataatctcattaattcctcaagccgctcactcttgggtttttgttatgtgtagatcaaactagtcctgatacacagcatattatgtctttttaaaaaaatccattcaatcctcctgccaaaattttctagtttgtctctcaatgtagctatcaatccatccatacatctattccatctatctctccatctaactaatctatcatctatctatccatcatttatctgtctgtctttctgctaaactacctacctatctattatctagctatctacctatcttctgtctgtcatctctctacctacctacctatcatctagttatctccctatcatttatctgtcatctacctacctattatctatctatctatctatctatctatctatcaatctatctatcatctatctatatatcatctctctatctaatctatcatctattatagctagctaggaaccatctatctattctatcatccatgtatctatatttgtatctatctatcatctgtctatctacctatcatctatctacctatctataatatatctatttatctctattttatctatcatctagctatctagctatcatctatctattctatctctatcgatctacctatcaccaatctattgtctatttatcatctatcaatcgatcaatatatctatccatctatatctatctatcatctatctatccatccatctacctatcatctgtctactacctatcattcatctatctattatctatcatctgtcatctatctacctatcatccatctattatatattcatctatcatctctcaatctatccatatttatctatctacctattatctatctatctatctatctatcatccatttatctgttatctatcatctccttatcatccatctatctatctgtctgtctgtctatctatctatctatctatctatctatctatctatctatctatcatgtattaatctatatctatcatctatctatctatctatctatctatctatctatctatctatctatcatctatttatccatccatctacctacctatcatttatctatctatctacctattatctatctatctatctatctgagtagcaccatcctaggagcttttctaactgtatctgtggggaaatcacaaaaatcggagtgattttgtttttctttctgccataagaagtcatcatgtgaaagtatgctagggtcatagactagacttgcacaatttcattttgtcttcttttaatttttcctctagagagcaaccaataatgctctttacatcaaaaacttggccttgccattccccacgtctcattgtatttgaagttctaaagacggtgaatatgactgacaatgtcccatctaacctggctcccatggcagctccctcctcctcttccttgcttccctagactttcttgaattcagacatatcagtctttaaatttctgggcaaagccaagtttgttccctccttaggatgttggtctagagcccttcacttctttcttggggttcccttggtggtgtctccctctgatgtctcagattcatataacttctgcagataagtttccattattcctgtattctctcaccctgtatgttacctttagagcacttagcacaagatataggtatataatatatataataattttgtatgttttctctcctcttctactgatccatagtctctatgacagcagggactctgtttcttcattggtattattcagtaatttgtaccgattcatagctcctaatacagttaaccatgtgtatttgttgaaggaatgcatgtgcaatctcttaacaatcttcatatgctttatgcaaagaatatgaagatgcaaagaatattcatattctttgactcatttccaattttaacaagatcatgtaaggaaataacaaacacacatacaaataagatgatgtttttgcatcttaaagaataataaagttggtctgtaaaggatattgtacataattactcattcagccattatttttattagtgaaatgaaaataaatatgatcactcacactatatgtattttatctcatcatttcagtaataagcaagttattgtatcttgggagactcttgttttataaattactaaccgtctcctcctgggagccctagtgctaaagttaagtaaaataattatttttaaaaatggggccaggtgtggtggcgcatggctgtgatcccagagttttgggaagttgaggtgggagcatcacttgaagtcaggagtttgagaccagcctggacaacataatgagacattgtctctataaaaaacaaaaaaaattacagatgtggtagcatgcacctctagtctcatctactaaggaggttgaggtaggagaatcacttgatctcagaagtttgaggctgcagtgagctccactgcactccagcctgggcgacggagtgagattgtgtcttaaaaacaagcaaacaaaaaaaggttgaattgtctatcctttcttaaattaaaaaaagtaaagaccttgatgcttttgaagacatgaatcttcagaatttactttttaattgatgctaaatttccacacctctcaagtactgtgacttaagaaagaaaagcacaccttataagacacagggactcactctagccatctctgttacacagactgatttcagggtccggccaagcaaaccacaactgccttctgtggaagcttacatgatcaatccaggggcatgaatcctgtttctccaataccaagcttgtcctgtttatccaatgccgatagttttttttcttaaaagctcacagcacagcattcaaaccgcagttcaggttcttctacttagcaagacattgaacaacttagtgagtctctctcaccctcagtttcctcatcagtgagctggaagtaatagattcctcacacagccctgtcagtgactattgtggtgatgtggatgaaaccaatgttaagcccaacatctgggctatatcagagactccagcagtgctagtttgtcagtattattcttttcctcatctttgtctttacctttctttcttatcttgcttctcatgctttttcttctcttattcctctttctcctcaatgctattttactcacttggcttctccttaccatagaaaatttccagacaactggcgaagtgataaaaagcactcagtgcactgcaggacattttgtctcagtttcattgagtctttctcatttgtaaactggactgttagtgccctgaggagctaaatagtctattggatgctttcagttctcttgcctagaacaggttccacagaaattaaagaacagttaaataattggaggtttgaacaggctaatagatgaagggaagagtgcctacttgtctttctttcaaataagaaaccaaggctgaataggatagataggatagaaagacaggaaggtagatagatagacagatactaggtagatagatagatagatagatagatagatagatagatagataatagatagatatgattgatagatgaatgatatgataaagagatagatatgatagattgatagatgatatatatgatagatatgtagagatgagagatgatagataatagatatgatagatacgatagttagatgatagatatgatagataaattgatatgctagataaatagatgatagataatagatgattgatagatgatagatagatagatgatggatacatatagaaatagatgatagatgaaagatagacatggtagctattgagacagataggtagtagatgatagatatataatagatgttgagatagacagataacagatagatgatggatggataggtaggtagagagatgatagatatatggatagttaaacagatgatgatcaagatagataataagtagataatagaggtatataatagatagatagattgattgattgatagataaaatggatagatagataaatagagagaaatagatagatgtgatggatagataaatggttcaggattatcactgaggccaggagtttgacaccaacctgtacgacataatgaaactacatctctaaaaagaaaatttgtcaatcaagatggcaatgagtcccatcatttctattatttatcgtgtttgttgcttatataataattgtctatcattttcaatccattttagcactgtggatccaagaacatagggcgtggcattttgtaaatgccttataaatccttgttgaataaataaagtatttcccactctatttccttgaagtttcttaacatgttaaattttatactcatgcacttatttgtgaatcacctcgtgaatgaattcctgattagtttgagatataaatactacaattgaatcaagtccttggtacatctaggtagatattttcctgagatcaagcacatgggcctctgctaatgttaccctcaattttccctaatccttttgactacccattatgaatctattttaaaaaatcttttttaatctggaacttaataatctttgcattcttatcttcaaccagttcttggactaacaattctctgaagtgtaaattccatagtatttttatggataccaagtcaggtccttgaagacttcaaggagctctttgcagtactcctagcatttgtttagtaagtttactatttatgggctttgctgctcttctctggaacctcagccattgagggtgaggagtctctctactggcttcaaaggggacttttatttctggaccaaatctcagtgtagttttccctaaggtagaaaaagtaacattttgaaaaccaatgcatgtactcagaacatcaggaggaacttgggggtccatctggaaactaatttgttaattagattaattaatgagatcaattaatccattaatcagttatgcccccttatacatgtatttgaatttaaaaatttcctattgcatatggtaacacagactcatgtgcctacatatacataacacttgcacacatgtgttccctacatacatgcacatgcatgcatgcactcacacacaacaggtttgctttcgtattacctcagcaaggcagagactcttatgaacgtgattcttgtttcatcacaagaaaatgctctctttttaggaggaggcagagatgtgcagaataaagtctcaatcatcgagcatttcttccagcaagatgtggtcatatggttaagttcttgcccaaaagatgtgcatgtagtctgtgttgtgtcctgctttgaacaggcagaactcacttctcctgttcctttttcccttcattctttctgcatagtgagcattgtgataagcccacttggacctactggtgaaggcaacatccaggaacagaaaaacaacagggtcaaaaaactctgggttcttcaaatcccggagccatcaccaacctggactgtttatgctgggacaactccatgatggtgtaattcacactcttttgacaaaattctcatattcacagcaatgtcattttgaatctgctacaggagccagaaccagatcctaactcactttcttagtctctgttaaaaaagtagactttattgtgaaatcatgtattaaattttagactcttctaaattcaattttcgtgaccaatttccccttagagaattttgttttccctgaatctccttcctgctgccttctcctaaaagcatgtctttatcttgtactgatttacagtacattttttgaaatgctgtttggtttctttgagagaaaaaaatcacaactgctattgtttccccttttctatatgaagattgggaacttgaaagtacttattggtatcatatagataatgctttgtacctaacaggaatgtgcaaactttttgctactccatggcttcaaggtgatttcccttatctatccacctaagctatgatatcattaagaccctccctaaatactcaagatgtccgctctccacacccccccaccccctaacaaaagctacgaatagatttaccatacgatccagcaattccactgctgggtatacctagaaaagaaatgaaatcaatattggagagatgactgcactctcatgtatattacaacactgttcatagtagttaagatatagaacaacctaagagtccatcagtggatggatggataaagaaaatgtgcatatccacaacggaacattactcagccatgaaaaagaatgagatcctatcatgtgttattttgtagttgtatgggacaactacccatgttatccccagttagaaataatcatacgctcttttttgtggcttccctagaaacttatctacagttctagcacaggtcttcaatctctcttacaacattggtacatgcttatggctctattccattaattaaagcattctcagtggcataattaaggttttactcatcctattaatacctctcaagtgcttagcatggtgcttatagctggacttttacttctgagctagatagttttccaggagctctaatccaccttcaaggattatgaacaaaagttcatgtgtattgtatttttccaggaagaacttgtggtttttatgagattttgacaatgttgcttgagattaaagagagaaagagagagagagagagagacatggaccttttcacatagtagacattcagtaaacatttgctgaatgtgagtgaattatagaggaagaagtgagggcatacatgtatttatgaacagctttagggtctctccacagactttgcccatttttttactgcagcttctgctgagatggttcatccatgtaggtttttactcattttatgcagctgtgccttacagtatctgacctttaacttcttacttccttctaggaagattttcctctgaaaggtaactcctgatgaatgagaggcagagaccaatggataaatggataccaaatcctccatgtatactgggagtagacagttctgatatatatttcacaagatgcctcaaaacgcctcatagatgctaacatcatttgaccattgagtggtgaactccatccataaggcatctttgtgtgtgtggggtggggagaggttgtttttgcttttttctttgaaataaatactttttgggtagtaaattatcatgttttcaattgatgcagaatagttgtacatgtttatgggatacatatgaaattttgatacatgctgatatggtttggctctgtgtccccacccaaatctcatcttgaattgaaatcccaggtgttgggagagtgacctgatgggagatgatttgatctgggggtgaatttcccccttgctgttcttgtgatagtgagttctcacgatatctgtttgtttgataagtgtttggcactttatccttctctctctctctcctgccaccttgtgaagaaggtgcctgcttccactttgctttccaccatgattgtaagtttcctgaggcctccccagccatgcagaactgtgagtcaattaaatgtcttccctttataaattacccagtctcaggtagtatctttatagcagtgtgaaaatgaactaatactcatgctttcactgtgtcatggttaaatcagggtaattcatatatccatcatctgaaacatttatcttttatgttgaaaaccttccaattcttctcttctagttattttaaaatatacaatacattattaactatagtcaccctactgtgctattgaacactagaacttattctttctatctaagtgcatctttgtaggcattagccaatctttcttcatctgcctacacaaaaacccttctcatcctctggtacctgttattctactctctacctccatgagatccacctgtttagctcctacagctgaatgaggtcatgcagtatttgtcactctgtgcctggcttatttcatgcatgatctccaattccatccatgttgctgaacatgacaagatctcattttttacatggctgaataatattccatggtggatatgcacattttctttatctattcatccattgacagacacttaggtggttctatatcttgactattatggatagtgtgatatacatgagaatgcagtcatctctccaatattggcttcatttcttttgtaggtatacccagcagtggaattgcgggattgtgtgatagctctacgtgtagcttttgggggaacctttatactaatagtgtactaacttacattcccaccaactgtgtaggagggttccactttctcttcatcctttcgtaaggcatctttgaatagactttcattttctctttcagtacctcttctttcattgtttcttgaaatcgtgtaattaacctacttgcactaaagccagaatacctgggatgcatggttgtaaacatttcaaagaacatctacacagcccataagttatatataatatgcttatctgatctgttcctcagtagaatatgcaattgcaaatcacatgcacattgtaactggatgggtacatttctctgtctaatatagtttcttaggatggacttgtgcatggtaaagtcagtaaatgtgcaggcaaagaaaactcagaaatccaatggatttgtttaaagagcctctgtaatccacaaattcatttccgtgccgtaatcatcccaacctgccatttacaaaacaaattaacttccttatttaaacgaaagagatagtattgtgctacaagttatcagtgttcttttctgtccctcccccaacataattttttctccaaacaggtattttgggacaaaatatctagaaaaatatttcaaatttaaatatttatttgtttaaattttagtgataagataaagaaactgtccacaaaatactcttggatattagtcccaacttttcaaaacaatgcataatagaggtgcctggaaaaattatgttgtaattgattcatcagttaaaaataagattaattccatctacacaaagggctcagctccatgcttttggataagtaataaatctcttatatcttcacatccttataaacagggaaggtctgcagtttaaatatttggtgatctgagaaactgaatatattacaactcatagaacaaggctttgctgtataagtcataagcactttaaagaaaagaaaaagagaggcagccacaggtattccaccgtattactgtgtatttgagtgaaaaactatttctatgtttactctagaatattgaagactggatacaactgtgtttctggaaattcaatagaaacaggttgctacttagcaataatgacataaggacattcatatatcactgctcctataagtgtccattcaaaacattgatccctgtttttgagttggtctcttcattactggtgctttcaatgaaaattttcatatgtgtaaacacaaatatgaaattattatttttaaaatatgacctgaatttatgtatgtaaataaaagtgcatgttggtcccctctgctattcccttggatggataattatctgctgtctttgaactgaaatgggtctttgtgtctttggaccacatgtcccaattgacatccaccttccctggcaccatatttactctaactgagaagaccagtggatgagtctggaaactgtaacatagaatgtggtagtttcttcccatgtgcaaaacttatttataaactgctatgccaaaaaaaatacatatataaataaactttaacgcaatgtaactgactcagagctttaaattagctactacattagatagaacttttaaaaatatgctcgtttcaggaatcacacatttgttaaaatctctgaacaacagttagaaaaggcagcatttgtgttaaatgtcttcatgttagaaaacactagatttttttgagagcttcatatattgctagaaacatgagtgatgggtaatattttaaggagtctacacatctgtagatatttcaggtacctaacttcccttaaatattttattttattaacaatatggggccttgacatttctagttttgtgtcttttttttttttttgctttacatgatggatggatagtgatacctagtttgagatttaacatacgcattatataggatgatgtacctttcaccatagcaggtcaataatctatttttatttttgtttcctttcctatcttttaaaatcatttttaatatttaatttttgtgggtacatagtaggtatatatatttatgggattcagaagatgttttgatgcagggatgcaatgtgtaataaacacgtcatgcagaatggggtgtccatcccctcaagcgtttatcctttgagttacaatccagttaaactctttaagctatttaaaaatgtacaattaagctattattgactataatcaccctgttgtgctgtcaaatagtagtcttatttattctttttttttctacccattaatcattcccacctccctaccatcagcccccaattacccttcccagcctctggtaaacatccttctactctctatgtctatgagttcaattgctttgatttttagctcccaatgaataagtgagaacatgcattgtttgtctttctgtgcctggcttatttcacctaggaaatcagtatatcagagagatacctgcactcctatgtttgttacatccctgtttataatattatagctaagatttggaagtaacctaagtgtccatcaacagatgaatggatgaagaaaatgatctctgtttagatcttcatgttgaaataaagcttacgcatgaatgagttgccttgttttaagttcggattctaggaataattaaggaggcaggagaacatgtagacaatagtttttattacttagataattcccagttacttctctaagccatgtattctttctgtacaaaggtcaggcaagtaatcatcaggtagtttccagatctggaaccaatgttgccaaagtcattctgagaatccattcttgaaataatcaatgttcggtgcataacttattttagattcttacctaagccttcctcacttaagtttggaaaataagtttcataaattgcattcatctcagcatgactttacttgaacatagaagctgatgttttaaaaaacaagtatctaatgaggagttcactacacaacattgtgtgtgtgcgtgtgtgggtgtgtgtagacataatgtattttctttcattttccatttcagattcttatcgattgattgttttaatttttcagattcttattaagcaaggagaaggacatcaattatcttattactgcaacctattcagaagggaattttagggcagtgagtaaaatagaaatctctataaaatagaaatctttatggattatatgataaaagtcatcttctggtaatgacttaaccagccaagtaaactaaagctgcctctaaatatgtagagacagaattgtctctgaaatgtatgtttataactaataaagacagtttcagttatccacacaatggtctgaatagtggcagattaaaccatgtttttaggctggcgtgctggctcccacatgtaatcatagcactttgggaggccaaggcaggaggatcccttgagcccaccagttcaaaaccagcctgggcaatatagggagagccctctcttcaaaaaataaaaataaaaaaaataactggacctggtggcacacctgtagcctcagatactcgggaggctgaggtgggagaatcacttgagcccaggaggttgaggctgcagggaactatgatctcatcttgtcactgcactccagtctgggccacagactaataccctgtctcaaaagaaaaaaagcgtttttatatccttattgttctatcaaccaaaatatttacacaggcacctatgaagaaatgtctctctttgtatccataaatatgtatttatagcatatatacacacaaaaggacatatacatgtgaacacatatcaagatacatccttcctatgttacctcgaaagctgttgatcatctttaagtaaactgctactcttttcaccttcctactgcatacagaaaactgagctggagcttgactgaaaacagtggtagcgtttggagtttttgtgtttacgatattcgatctaggatttgtgcattttattggagtaaaattatatacagtaagtatatacattgaagtttgctgaacttcaatgtatagtccaatgagtttataaatgtagatgtttctattcatgtgaaaacattactcaaatgaagtctttagtgaatgtgttgttttttgcataaaagtgtattgatgggaattgtggattgttggtcataaaagaaactgcccgatttacatagttattgcacagttttacacccttaccagtaagaactgcagtagttcatgtcttttccaaatcttggtgttgacagttggctaatttcagctattttattgggtgcatggtggcgtaccatggttgttttaattttcactttgttaataagtaatgataatgagaatcattttatgagtgtgttgtacagtcctttatctttgttcctatatgtgtctatttaaaacttttgttctttttttgaattgtttatgcctttattattgatatatattaagtttgtgtaaaatatgactatgagttcattgccaggcatttatattacaaatacatttgctcactttatgccttccctttttatttatttaatgtttctttggatgaaaagttttaaactttgatgtctccagtttatattattattataagattagtattctgctcagaaaatctttgtctgttcccaagttgcaaagacattctcccatgtcatcttctagttttatttactttttattatcattttagtcttttatatttcagtctacaaatcattctcagtttattttaggggacagtgtgaaatatagatgaagacgtacatttcctttactagtgaatccagtcccagtcattaaaacctcttatctttccccattgatttgtgtgatgcaattgtcaaaattgtttgtgagtatgagtgggtctatttctgaactaccgactctattctatcagtctctgtctatccttataccagtaacacattgtcttcattaccgtagtttcataacacatttaaaatcaggtcaaataattttttcctttattttcaaggtttctttttggcaactctagatcctttacacttacattaaattgtagtctcagcttgccaatatctgcaaaactctgggtgtttcatttgatttgtttggaatttatagatcaatttagggataactagcaatttcacaatattaagttttccaacccatgagcagggtaaatttctttgtctacttagggcttctataattcaacctgacactgttttgcagttttcagagtagatgtttttgactacttttcttaaatatattttagatacattgtgttttttgatgccattgtacacaaaagtgatttacaatcaattgtaaatagaatggagtcacatacggtgattgtttattactagtgtatagaaaatttgcagtctgggaacttgtagaacttatttataggatccagtggtttatttatagatttctttgaattttctacatgcataatgccacctgtgaataattgtatttcttctttctcagacgttgtttcttcatctatctctatctgtccatctgtctatgtatttattatctagcatgtctacctatccatgttatctagcatatctatttatctatatctatcatatctattatcatatccctctgtctatccatcagtatactattattatctctttcttttatctgtctataatatccatctatcatctatctatgtatccatccttcctatctgtccatccatctcggtgtctataaattatcatttgcatgtctgttatcaatctacccacccattatctatctacgtatcttcctttttgtctgttttgtactataagatcagctagaacatctataaatttcatttgaagtgttaagagggacatccttcctggcattctctccaattttaggatagaatgtgttcaatatttaaccttaaagtattatgttagctgaaggtttcttaaaggtattctttatccaatggaagaactggctcttccatttctactctgttatcattgaatgtgtgtgttaaatcgtgaatatatgttggatattgtgaatggctttctctgcattcattgagatgatcatagtgtttttctcttttaatttgctagtgatgtggttaattacactcttcttaaaatgttaaacctactttgcattcctggtatcaacctcacaatgtaatgaagcattctttcttttatatttagctagattccatctgctaaaattttgaggagagttcctgcatcatctattgtcatgagtgatattagtctataaattgctcctttggttttagtattgggattatgctggcttcattattttaaaagtctggaagtattacttcctccttttaaatacattaatctaagattgttttaaaaatatatacattcagtagaattcaccagataatccgagtcaagacaaagtggttgattttggagcaggttggggagggggcagtggcggcagctagctgttaactataaattcaatttctttaacagatacagtgctatttgggatgtctatttttttgtggcagtgttggcaagtcgtgtttttaataaaatcatccattttatctatgctatcaaaattctaagaataaagtcattcataatattcccttactatctctatggaatttaaggcaatatcctctcttgcattttttattttggtaatccatgttttctctttttttttccttgatcagtctaatagcttatcaattgtattgctcttttcaaataaatattcttaaggttttgcttttctaaggttttggttctttctatgttatttatttttccttttttattgacctgtgttttctttttgactttagccaatgttcctttcctacattctaaagtttaaagcccagatcgctgattttagatagtttgtcttttttttaactgtaagtatttaaagccatgaatttctctcttcacatgattttagctgtattgcataaatcttgaaatactgcacactgcgaggaacgcgcactgaggtagagactcaggaagttcacaccatttacagggagaaggagcctggccccttctcttcctgtgcggaactagggatttgaatggccaggcagaaagtgctctagcagggactccggccttgcgaagagtccctggttcctccttttcttccttttcacccaataaaaccctgtcttactcacacttcaaatagtctgcgagcctgaattttcctggccatgggatggacaaggaccccgcctttagctgaacaacggaaaagtcctgcaacacttgcaaagtgcataagttgtgggacatcgtgtttcataaatatctattaagttgacatgattgatagtgtggttcaaatactctgtattttccaacctgaatctatgtacttatgttttttgggatttttttttttgtcaacttgttttgaaataggattgtccccatctccaactttatggatttgtctgtatgtccctttatttctgtcaatttttgctttattttctttgaagatctgtttttagagacatacgtatttaggatgtttatatcctcttggtgagttgaccctgctatctttgtgaaatttgcaatttatatctggttatcctttcttttgaagactattttataagatattactttggctaatctgacttggcaggttctttgctaaaactggcaattacaaggaaatgcacccttgtaaggtactggacctaggagaaggatcagaggcctaaacaaaatttggtcaaacagagaatctttgtcgctacctctccttgacagtgaaactgacccaaaaatcccatagactgttcttttggattaacgtgcatatgcaaaggtgttcaacgtaattgatcagagaaatgcaaatcaaaactacaatgtgatatcatgtcactccagttaaaatggcttctatctaaaaggcaggcaataacagatgctgtcgaagatgtggagaaaagggaacccttgtacactctttgtgggaatgtaaattagtacaagcactgtggaggacagtttggaggttcctcaaaaaactaaaaatagagctgctatatgatccagcaatcccactgctgggtatatactcctaccaaagggaattagtatattgaagagatatctgcactctcatgtttactgcagcactactcaatatagccaaaatttggaagcaacctaggtatccattaacagatgaatggataaagaaaacatggtacatatatacaagggagtactattcagccataaaaaagaatgagtttctattatttgcaacaacctggaggaaattgcagatcatgatgttacgtgaaataagccaggcacagaaagacaaacatcacatgtttttacttatttgtggaagctaaaaattaaaacaattgaactcatggagacagagagtagaaggatggttaccagaggctagaaatgttagttgggggtggaggaggtggtgggaatggttaatgcgtacaaaaaacacagttgtaatgactgaataagacctagtatttggtagcactgcaggttgaccacagtcaacaatactttatacatttaaaaataacatttgtacatttaaaaataagaagtatagttggactgtttttaagacaaagaataaatgcttgacgtgatggaaaccccatgcaccctgatgtgattattatgcattgcatgcctgtatcaaaatatctcatgtaccccataaatatatacacctattatgtacctacaaaaattaaaattaaaatttaaaaaaattaaaagcaacgttaacttgatcataccatgttaatttgagtgacaaagagaaactgatagaatagtaagaaaataaatgcactttcaacattcgtagcagtggtgaacttgttcctgtaataatagcaccaaagttgcatatactttttaatacttcataacaaacaactgctgagttacaaagtaaatatttgacaaccatgttgatcttaagaccaaaactgccaacagcttgcaaaaaatattgcagttcatagttatcatgtatctatttaactgctgaaaatgccacttgtttatgcttcccggctatttttcttttctttctgtatgtcagtcatgtgttacccatcctgtacattttccactccatgcttaatgtataaaaaaagagtggattttatctgaatcatgaaagcatacacttttgaagtgtgttacaatttttttgatatcctatttttatatttgccatttacatgtgagtaaatgtatgatgtggcaatcataatcaagcttcaataggagcacactgataataatggaagacaaatttaaattgggatttctctacatttcacgtccttggagatgatgctttctagttgaggtcatgtttgttcatttctgtgtttatctctgacccactaatacaatgcattgctcattatcaatcctattttagttttaaaacttaaatttttatctatttatacacactaggaattacacacttcttcacttttcttaatttacttggtctcattatcctcacaatatataaattaaaaatgacatgattgatgagctagaaaatttccacacagaatgcaaattataagtaactgttcaccatgcatttcttttattttcaatggaatggcgttttcacataaataaaaagaaaaataaatcagcatctaagcatataatactcccaagaattctcttcacggagcagagatgaaaatgactctggtcaattggtgaaagaaatacagattacgagaaaaagcatgggactcaaaatcaagaaaatggagtatttagatctgctctgtatttgaaagactcaccatttgaccagcattaattgagtatctactacgtgcaatgcactgtgccaagatttagttctatgccttaccctaagcctttgcctagaactttcaaaaacacctttcaccaacttttaggttgctggcttccagaagacaaatacctgtaaaaccacaagtagaaattagaaaatattgttagttttctttctatatgccttctcacctcagtcttttaaataactttccaatcatcaaatttccaacaatttcaatgtttaaatttctcagtgttaatatgcaaacttcaaacactgtttcaataatccacacttatgaaaacagcaatgcttgaaggaagcttctttttgtgttgccaagtggaaacctcccaaatctgctcaaggattggggagagtaggtgaggctggtggtttagtctctacttcaccaaatttactgtgtcctactttttttttttttttctgagacagggtctcactatgctgcccaggctggtctcaaacccctgagctcaagtgatgccccaaccccagcctcctgagtaggtggtgtgtcctacttttgaaagcaccttcatcttttgttacatactttgtaaatctatattgaaactatatatacatgtgagagaataaggcaaaatgtaattatgacttccctttctaaactaagcagggatacccgaaagaggcaccaatgaaaacaaaaatgtaactctgtctcattatttgcaactacttctctcctacaggagctgcgtcctatttattttacatcctccgtatgtagcatcacacctggcaattcatgcatttttaaagaaaaaaaaaagaatcctgaaatatagtacaataggtaggcacattgtggttgggtatttgaaacaaaaatcaatacctggatttttatctcatagtacaatctattatggaaacctttttgaaatataaaatgcttatatttgaaaatgaactcctctgctatacaaagacttccgtttatactctatttgaaggtggttacgatctgagcacttcctgggcaaccaacttttcatttaaaaagggagttctgagtacccacagaactctaaacatcagtggttccatttctctgcaatttagggaatgccaaatagaaatagctaggtcaataaattttttattgtggctgattactgatgagaactttcagcaccctatttagaattttcaagtttttgcattaaaaaatactggtggaacccagtgttcaatgtcccttctacccacacatatgcatcctgtgtcagtgaactttgaggtggtctatgcatcctttattgtggctggtgattaatgagtactttcagcaccctattttagagtttctgtgaactttatattttttgcatttaaaaacatgctggtggaacccagtggtcaatgtcccttctacccacacgtagacatcctgtgtcaatgaacttcgaggtgctctatacattctttattgtggctggttactaaagagcactttctgcaccctattttagaattcatattctctagtttttgcatttaaaaatatgcgggtagaacccagtgttcaacgtcccttctacccacacatagacatcttgtgtcagttaactttgaggtgctctatacattcgttattgtggctggtaattaatgagtactttcagcaccctattttagaatttgtgtgtactttccagtttttgcatttaaaaacatgctggtggaactcactggtcaatattccttttacccatatatagacatcctgtgtcagtgaacttcaaagctgctgattagttttttcctccataatatttgacctccataactgctactgaaaccccaattttccaacttccttgactaattgaagaataaagtattatgagaattttgaagctgacatttctataaggctaaatttatgttgctgtgccctttagggaatgctttggaagaaaattccagcatgggatcataggattcaaggactaagggtaataattatgccttcctcgaacttttgctaaactcagatccatctctatgcatcacttacattaaatcaagtttagcctaaagctgcctccttatgtattttaagttcagcctaaagacttctctgtacatcttgaactataacatctaaagaaagttgtaagcagactgtagcctactcttgtgccaatcactgagttttggccaatcaaaggcggccaactgttcaaattgtgttcaaataagacagacaccgagttgtaaccaatccggctgtttctgtacctcacttccatttctgtacaacactttcctttgttctgtccataattcttctaccacgtggctgcactggagtctccaagcctactctggctcagcaacagcaattaaactctgttcgatttaatccagctaaggtttttcttttaacacttgatatacactaatattgattactgagtgagcatcctatgtatttcatcagagaatattcccaatcatttctgtctaacaggagcatactaaccatctctgtctattccctaatatatctcatttttgtaaaaacaacaaacaagcagaaatgctttaatatttctcatagcaaatattgtattaaaaagaaattatatcaagattatgaacaaattacgacaatgatgagatgttctcttcatcagcatgacaccctttaaaattcattggcaagactggctgtaatagttgtagagccttgtatacccaatggtatgcagagtagtataatggtcattggagactcatggtggaggatgggagccaaaagggataaaaaactacatgttgggtacaatgcacactacttgagtgacaggtgcactaaaatctcagacttcagtgctatacaattcatccatgtaaccaaaacccacttgtgccccaaaagctcttaaatttttttttaaattaaaaatatttaccttgagtgttgtactaatcagttcaaactgctataacagaataccatagactggttgacttaaacaacagaaatttattttctcaaggtttacaaagctgaaatgcccacaatcagggtgtccattgatttgcttcctggtgaggaatatcttcctgacttgcagatggctgacttcttgctgtattttcccacggcaaaggaagagagagaaagagagggtgggtgggaaagacagagacagagagaagagagagacagagacacagagagaagagagaaagacagggagacagagaggagagagagacagagacaaagataacagagagagatagagagagaagagagaggagagaaaggagagcgacagaaacacagacagaagagagagggccgggcgcggtggctcacgcctgtaatcccaacactttgggaggccgaggctggcggatcatgaggtcaggagatcgagaccacggtgaaaccctgtctctactgaaaatacaaaaaaaaaaaaaaaaaaaattagccaggcgtggtggctggcgcctgtagtccaagctactagggaggctgagg[137 bp omitted]agagaagagagacagagacaaagataacagagagacagacagagagagaagagagacagagacacagaagagacagatagggagacagagaagagagacagagacaaagataacacagagacagagaagagagaggagagagagaagagaaacagagacacagagagaagagagagagacagggagacatagaaaagagagacagagagaaagaaaacagagagagacagagagaagagagaggagagagaagagagagacagagaaaagagcgagagaagagagagagaagagagaggagagagagaagagaaagagagaagacagagaggagagaaagagacagaggagagagaggagacagaggagagagagaagagagaggagagagaagagagagagaaaaagacagaaagaagagagagagagaagagagggaatggagagagaaagaggagagaggagatagagagaatgctcatatgtttattcctcttcttataaggacatatcccatcatgggggccccatcctcgtgacctcatgcaaacttaatcaccttccaaaggttccacttccaaacagcatcctatcaagggttagagtttcaacataggaatttggggttgggggagcacaaacattcagtctataacgcgagttcaggtgggaatcacagtacttttcaaaagagagaagcaagataataacgatcattggataaaacaagatcgttaacagaacaaatggcttagaaaagaaagtcccaagccctgtgtccctctccgtgattcaggagctatgtgtactcccagtggattaacacacagcagaatctctggtcagtttctcttcagaaaaggaagaaattgtgtttttttccttacgtttctctgagaggaacatagaattgtagacactcaggttgaggtgagcatgcaatgggcacatccctcctgctataaatctcttcttggcatctccccagccccccagcacaagctgatgttcctacctcagaaaatgttcgcacacaagacaacgcacaccttcatttaggcagccacgtgcctggggcaggaacttgtcgctctctgagaagcaaaaaaggggttggggccatagaattgtggaccaaactatctgagataggtctcaatcaatttagaaagttaattttgcccaggttaaggacacacccaagacccagcctcaggaggtcctgtctacatgtgcccagggtgactgggacactgcttggttttatgcattttagagagacatgagacatgaatcaatatgtgtaagatatacattgtttcagtccagaaagacgggaccactcaaagtgggggcaggaaatgggggccttccaggtcatgggtagataacagacaaaaggttgcattcttttgagtctttgctcagcctttcactgaatataaaatttacatatgagagtggaatagagcaatagtcacttatactatagactggctcagtgactctgcatttttgcgtaaacaattgggcaggggaagcaaccagatatgcatttttctcaggtgagcagaaagatgacctgtcctgcacctatgaagataagctatccgcttacattgctagggtgaaattcaaaagaactctgtttttagggtaaacatcttgaggtccacaaggaatttctttgtgagcaaactgtgagggaggtatgtaacttttttttttttttttaatctttgtagctttcttacttaggaataaaatgggagacaggtttgcctgatgcagttcccagactgacttttccctttggcttagtgatttgggagtcccaaatcactattttatttttatttatttatttttataatttttattttttattttttaaatttatttttcctacacagaagtctttgtcaaagctgcgtttattggtggaagaaatgaatttttgaggtgtctctttgttttgcaaagtgatgacagggaaacaaagatcaaccaaagcacttttgaaaaatttggcaaccccacttctaagaatgaggccaggttgggctgagaaccctcattccagggaaactagtgggtgaccgagttgagtggctataatcacttcagtccaggaaaagcagtcaatgagagagatgttctgccatgatcacctctatccagggaaactaatccatggtggagatggtggtccctgatcacttcagccctggaaaagcagtccataatcactaaggcaggctgtgcttgcttcggcccaggggacacaatgatgagggacctagaatgtttattcctagttgatgataagtgcacatagttacttgagttactcattttcagaaaggtttatgcctgcttagaaaaaattctcatgtttaagaaaacgtgtaggatcagtagtatgtgagtgggctttctgttgttggatctctataattttgaacttttgcattcaatcagggagggttactgtaggccaaacctccagtgaaggctggttctgtgtttttccatggtattgattgtgatcttatttttcttgctatttagaagaatttattctctggggttaattgaggatctgctgacattcctcgttcattcttgtcacgaaaattgtttgataaccatagttttttatgatattttaaatccgagactttgtatttagctgtatgcagagaaaacttttttttaaatttttaaagagaaacttgttaatgccctgtttttatatttactgcaatctcctttaaatggactacaagcacaggtgcaactttttgtgttttttttttttaagagatggggtctcactctgttgcccaggctggagtgcagtggtgtgatcatagctcactgcagcctcaatctcctgggttcaagtgagtctcccttcttgacctcctgagtcactgagattatggaattgagacactgttcggcacacaggtgtgatttttaaggaattctcacccacttgctcaagacatgctatcaggatctagatgtcgtctagataatggtattcttctggaatcatggttgcagttgcacaggcattctcaggggcttgcttctgtgttcataatcagaggcacgggacataatagaggatccaatttagaatggctcagctttaagcagtaatggaaaaatttatgggtgacaggaagagcaacaaagggtcagtttgctattggaatacttacttccagttgggtaagtgaaaaggaaagaaaaaaggaaaaaaatcgaatcatttctgttgaaaaaattcgaagcatttctttgaaaagaaatgttagaaatttaaattctaagatatctgtttcttatttggtttagatatgaaccactctctaaacacagcccaaaatgaaataacaaaaacaacaatggcagctacaccagtaacaacttctactgggctctgagccacccaccccagaccccatctcttacataaataggaagatatttttgcatataattttcctcaattaaacataatatttcctggaagtttccaaagagagctttggcagcataagctggacagcgattaggaatcctccagtgatccatgaaaatgtctttgaggactatgtgtggtcatggattaacctgcaggaatagcttgcttgcacgtcagaatgtaaattctaactttccacccactaacaagcctgtttccttccaacaggagcatgtcgcagggttttcctactactaagtaccatctttaataaaagaaatcccttctcattatcagaaaccaccagtttccctcagttgtcttgtttacctgctgaacaaccccagaagacatgcctaaagcacgtacttggcactgaataaatatatgttgggcaaatgagatgcatttctctatgagacaactaatccagaaaatatatttttttcctgttgcagaagtcttcattaaatcacctagaaagtttcttactacctatgttcattttagctcaaaaatttcaaggtatgttttcttcctaaataggctttcctataggacagtgcttctaaacgtgtgtttggtatgtagaacccagggtgtcatggagacccactcagggaaacaggcaggccagaagtattttcataataatatgaagacattattttcctttctcactgggttgacatttaccttatgctgcaaaagctagtgacttagcatggatgaaggcagtggtactaagccttattggtttgttatttcattctttctgactggcactaacagtagaacaaacaaacaaaaaagaaagaaaacaaaatttacctaaggaagtcctttatgaaacaaattcattcacttattacatatatattgaccaacccctgagtacacatctttttacggtggaacatgggttttactagaataggggaatgataaactatgtttcttctgacttccagtctagggcagacatttcttccaaaatgaatgaagtgaattagtcatttcatggaaaacaactaacagcatttgttgacagtgatgcatttggacttgcaaaagaaccatagaattttgggaaacttgcatccaatactataagctagacaattttccaatacataaggtgtttcataaagaatacatcggtggtgactaacatgtgattttttaaatattgcataataaaaatttgtcaaaatctgtaagatcagcaaaacttagggaagcgatattttccaagtgcatattgtatgatgctacacaatcatgcatggttaaaagagcccctcaaaaatgcaatagataattaatgtagttaattattgatattaatctaacaaaataagaaaatttcattgataatgatttcagattccatatggcaatctaaaatttctttaaaaaactgccattccttgggttttggtgtagtatcaaaccccagctacctgcaaacactattagaatatttctcccttttccaattaccatctgtgaaaggccagattttctacatatatcagacaaaacaatatattgcaggccaggcgcagtggctcatgcctgcaatcccagcactttgggaggccaaggtgggtggatcgcttaagctgaggagtttgagaccagtctgggtgaaacctcatctctaaaaaaaataacccatctctaaaaaaaaaaaaaaaaaaaaaaaatagcttggtgtggtggcatgcgcctatagttccagctacttggaaggctgaggtgggaggatcacttgagcctgggaggatcatttgagcccaggaggtagaggctgcagtgagctatgatggcatcactgcactccagcctgggtgacagagtgagaccctgtcccaaagcaaacaaacaaaaacaaaaaacaaaagaaatcattgcaacagattggatacagaagataagagagttcatctgtcctttattaaactagacatttaaaaaatttgcaaacatgtaaaagaatgccatacctctcattaattttttttgccttagaacatagagttattttaagcaaaatatggtatttattaatttgtaatatttattattgccattttaaaataagttaataaatttatatatatttttaattctaagtacacagtggtaaatattggacaggtaaaactcacatcaacaaagctttctcaagaagtttgaagaatataaagagattttagggagtttgagaaacgctacttggcgtttcttgacctattagaatagcctttataagctgtaatctactgctctgcttgagtcttagatgtgtcttggtagggtcagattccttttaaaggtcactccaatcttaaaactcacacgggactcctactatctgatggcttaacctcctctttcattcagtaacttccaattgataccaataactacagcgaaccagtttctgctgttgctgtgattccactgatccttcttcttgtttctgtgtttgatcttcacaacagcccactgcggtatcaagattttgataaaaatccaaatcaggctaagaaactgtgaaagctgatcctacgaagtgagtcattcttgtcatacccgacgaaaacaagagtcgaccaggaggaaaaagcacttgggcacagaggattgctccaaaaatggaattctctgcaagcccagcagctaaaactgcctgctgtgacctgaaactggttttatctaccggctgctgaaacaaccagctgtggttgccttcactgatggatcgaaacttgccctctccccaaaaccttattagtgccaatgaactttcacaaagagcaatacataacatttctccttctcctaaaacctctttctctttgttcttcaggtctgtgtatatgccccgaattgcaattctttcttcctaaataaatgttttcatttcagagatttgcctctgtattttatttggctttgacaaaaccaaggtttaggggtccgatagcctgtccgtggccacttaccccagaagaggtttgctttttccaaagtcagaattctgaatctctgtagcagaatcccttctcagcaaaagggtcattgctttccaattaattacaggtgtttttaggctatgaaaattacacatgtagatgtacaattcatttataccccatgctgtttcaaatcaagccatgtaaattattcaaacccactgggaagttcattaaaatgctcttatatttaaaaaatccaaaaaagtatctcgctctccgatgtcaaacttaattaattaaacattttaaatgtagtttttataatttatagtgaacatttccactttaataaccttcaatatttcagaggcatccaagttagtttctgatgtatttgttttttctaaaatttcagaaaattggtacatctcttctttcttccaacttttatctttatagtaacacttttacatttccaagtttctataatgtgagaaagtcttttgggctttattgttggttgaattccaaaatagttctaactcaataagagaaagtattccaatattatgtaaatattattcatttacaaattttaattggattcaaatggatgaaaatgtatttctgcattatttaaacttcactgctaaacaaagatactttcaaggatcgaggtttattggatcctgaattaatcacctatcctttcgatttggtgctatttcctggtgatctgtcctgatatgtcttctgtttctttccattcagttggaagttttctttaagaataaccatttaaaaaaaaaaaaaattaaaaagcgtgaatggggagataaatataaaaaatctgaattcttatatttaataaaattttgttctaacccttgaaggtttggcttcttctcagattcctgggttaaaataatatatatatatatattttccctctttggctgttgagagaccttgacttcattgtgaggaaaagtatgacatcaaacttatcatgataaattcttggattatttatttcttgacttttttcttttcagaatttttcatcagggagtaggacttttgttttcattctactttgcatttgttgagccactcatttctaaatttcaaaatttttttgagggaaatttatttaattacatataaataaatgtaatatctatttatacatatgtttatttatgtaactgtatattagactcgatgtatatatgttatgctgcacacacacacattcacacatacatatgtgtgcacacacgtaaacacatcttaccctcctgctttttataggaaccttttcttgttttctgcctggaccatcctctagaaacactttgagagtattaaattgacacaaaaattagaacattccctttttgttcttgagtgatctgtttgttctgaagttaggcatctggtttgcccaggtgttttattgctctaaatgttcgctgagagtggggtgtctcttcacattagggtgtgtagcatgtgtggtgtagcatagatggctggtgagtgctactaacacggttttgttggttcattttgtacccatgcccctctccagcttcccaggaccctcccccagtctagcatccctagtcctcattgtggtccaggaatacaatgttgcgatccaacagcattgcaatatgctttggtgctacagcttgtctctctatgatttttccactgccaggacgtagcaggggttgctccttttggtaatccctcaaataaatgcaatgaattgctgggccaggtgtcagagccccagcaatggaaaatcacgagctcgcgggtagcaagaatttaccgacaacagcatatgtttgaaaaggaaggtgttatcccatagaaagaatgctgcagaagaatgcagcaggtgcctcagtgagagaggactgagcgcacctggtgggcttttccttaggggtatttatggaccctaaagtggagctgaagggtaacttggaccacattagccacataggtcatgataaatgattacatttgtagacatttagatgccttaatgccagcaaggattgcacaatgaatttcgacatgtatgcattccagagatgtgtagaaattctagttactcacaaatttggggaaagaagcctggtactggatgacagctttagataatagagaagtctaaatacttctaaattccttagataaggagttttggttccggatggtcggtttgatagtcaccaggtggtctttgctctcctcgcaaatgagaaacatttaaatagctgagcaatgatgaaggtagatttattttatgtccttccttttgatatcattctacttaaaataatttcagccttattgaaatttatggagtaccaaaaaagtccgcacacattcaccaaattcgctcaaatttgctaaatgttaacacgttgccacatttgcttttatcacttcttgtgtgcacccatgggtacatataagaaaaatgaattcttagtgacttttttatttgcttgctattttgttttattttgtctttttgtctgtctttttctgtaagtgtgactgtgtgtctaattttataactgttgcatcataagttgcaaatgtaattctcatttacccctaactacttcagtgggtatttcttaaaatacatggacattcttttgtatatcatcagaacaatgatgaaagtcagcaaatcaacaattcttcaagactataatctttagacctgcagaactgctaactataccagtataaaacaaacctaccaagtagagttctagacgctcaaaacattcttttgtttttagcttgaggtatataggcacaatacttcatctgagagttacttttcccccaccatccttcaatgtggttatgctatttatttaggctcatttgttttggtttgtatgaacttttgcttttcttttccctccctgtctttttgattatatgtctatttttgagtatgtgaacatatgtaatactaaaaatgaaaataatacaaaaagtactcagaacagtgtcactcctcattccttattattcatcctcacctccccgatctttccatcctatttgcattcagccctgcaggttttgaacttcattagtttctgttttatttgaccatgcttctttttacacaaatgagccttcttatttctcatttcaccttttagcttctttcttgcacaaaagtttcattaacacaggcactgttttgctttttattgtttcacttaatattttttaaaatctctatataggtttgaaataatgtttttattttctcttttctatagtctcagaatatacaattgcatgtatgcaccatagattattagaacattcacctatggaagagcatttagttttattcccaataggcaatttcagacaacactgcaatagataattttacacatgtggattttcatattattggacatgcatcctttgcataaattctgagaagtggcattgaaggctgaaatggaaaatgaagtcttagtgattttttttttttggttatttttatttatttatttttctaagatatctccaaattatcttccaaaaaataatgcaaatttgttttcaactaaaaaatgatgaaggttttctcacaggcacaccaaaattttataaaattggaattggagaactggtatctcataaagtttgttttattttcatttttttctgagtttggcttaacattcttttcctgtgtttatgagttgcattttacatgcatcgtttattactgctttctacctgattttaatctttttctctgtttaaagaaaaagttttatctattaggtttattcagcatttaatgtacaatgtatgttgtgaatattttctctatttttatcagttgctttttgactttgtttattgtccattttggccatttaaaagttttctttttcactgtagtcaaaatatttttatatttgtgtggcatttggattttgagttatgaatatgaatctgcttatgtcacgttaatactggtatagattttttaaaacatttaatttccttattgagagtttatcttttccttccttgtgaaggacatgtctaatgtcattttttccaaatgtctgacaagttgtctcaataccatttggcaaaaagctaatctgtgcccagcaatttgagatggcatatttttatgcatatttccttatgtatttaaatctaattatgaacttcctcttctgctccacttgcttgtcttttataaataagactacacttctcttcaaaatagagacactgtgttgctttttaatgtttaatagggctagtcactcctcatggctattttgtatttccaatgtattttttattatatttacacatttgtgacccaggctgcagtgcagtgccacaatctccttcactgcacccttgaacccctgggcttaaggattcctcccacctcaacctcctgaagagctaggaccacaggcgtgcaccattaaacctggctaattttttgtatttttagtaaagatggggtttcaccatgttgcccaggctggtctcgacctcctgagctcaagtgatccgcctgccttggcctcccaaagtgctgggattataggtgtgagccactgcgcccggtccatatactttgaaaacatccttctgtgtttcgttaacatcatctgtgcacctttttatggaactgtgttaaatgtgtttattatcctagggagaacctacatcttaaaatgtctattattcatcttgtggcaaatatctaatttttcaagatccagcccttttgccctttttgggaactctattcaaatgtttggatgctggtgtctttctctattccatcattaatcgtagttaaaaatcaccagtgatgtttcagaaagagtaatccttcagtatagctggtgatatgagcaatatattcatcataattcaagaaacagttaccattttacagatagttcacatcaattccaaaatactctggatcaacccagagaaatgtgagagatagcaaatttattatttttattccatagacaatatgtcagagttttttcctgtctgtcccttttgccagaaaaatgaaatagttttataattcactccagagaagcctttatttaatcatccatgttaggacgactaattagagttttcaatacctgctcccaaccctctgaaaagaattatctacaagtattattggtggcggggtattagtatgccaaagctgttgtgtaatttctgccaaactcctgagattttatagctataatgtcttttaactgacttacactttctttcaataatgcaactgaagtagtattttctttgagatgtctaaacctatccaaattgataatatctgaataacaaagttctaagatgaataaaatccggtggctgtgttatcaaatgcctgccaaacatatttatcttcagagcccattatttcccataaaaaacccagcagtgactttcataactgttatgcatatgggctgggctcattaagacagtaccttcttatccttattcatagatgctcttctgattcaaagttaacatgtaatattatcattaaggagcacagaaagaaccttcattttctaagaagtcattagccataggtctttttctaatttttctgtagcatcaattttgtatattaatgaaaaccattattttgaaatacttaactggtaaggaagagaatgatcaaagaattgagataatttagcctaaagaagtaaaacctaagaaatgattgagcttcaaaaaattgtgcagacggcaactgtttctttaaagataccaaatacctttaaagataccaaaataggaaaccagcccaagtttgggggaaaattatgtatttttgaaattttagtagtatatattgtattttttttacaggatacacttgcatggtggttaatggagtcttccgtcaaaaacaggtgtgagaacttcagctcctgaatacattgtttgccaacccagttggccaacaaacattttaataagtgacccttatgattgtcagttttcacaagcggaagtacaaggtgaccagtttaatttaaatttcagataaactgaatatttgtagtattagtatatacaggcaatatctgggaaatattaggttggtacaaaagtaagtgaatatttatgtgaaaaaaagtgagttttatctaagatttaaattccactgagcagcctgtattttcttcggcaacttcaattctatttctgtgatgttccaggtagctaaacaaaccaatttgccataatcaccgtattaaataatgtcctggtctttgataatgggtgcagacacattttcatggatacgaccatgttttttcaaacaaataatactcaaaccctgactatacaaggtagataaacagcaaactttggtttggccacgttagagggtgaaggccttatagtggctgtggatttgacatcatctaggtcttctctttctctctaagagggtagagtgtgtggggtatagtgtgtgggggcaccctcaaaataagggggaattcttattgagtggaataacaattttggggccatacctatttgtaataggcacaaccattcacattagtgatcagtgatggctgggctaattcaaaatatattaaaaaacactaattgtaattgaagcatactcacatgtattattcttacgtggtataagagtgcaagactttcctgaagtatgaatatcaaatatataagagaaggaacatatgttttatatgtagtttaaatactttctcagataagggaatgtttgattttaaaaaaagaaaattcaatgcaacatgcattaagtacctacaacctactctgaattatctaaaaactgtgagaaataaaacgatgagtaaaaatagtcattgttctctggaattcattgtcaggtaggggagaatgatgtgcccattatattgagataaatgccatttttcattttgctggcttaaaagataacaggtataatgtgttagacaggaataattttatcaaaatggataaggcagctttacctagttctttgtatttataactaatagtctttctagatagagtttaatgttaaaagaaaaaggagtaagaaaggatgacttttagctagggaatggggaaagaaagcaatatactccatgaaagaaatagtatttcagtgttcacttgaagatggctagaatgttgaaagctgtagatggagaaagatattccaggaaggtggaacaatatcaacagttatttgctgttcattgagtttgaaaattaagtgatcagagagcttagcaaatgcaatttctatgccttgaccgtacagattaaattgggtgaaggaatgactttggagtgagtaaatagcaacagagtaaagaaagagaatagccgtaacaagatagagccatagggttgagagattattaatgttattatggtttttggacaaaactcgaggacttcaactccttctcatagcagtaaagactgaaagcctggcctgattttcaatatacatgatttaggatgtgtatttaatataagatttcagggatgtaatgacaggtggcaaaaatacttgaacaaaaaagaaagatgtctgatgcctctggttcttgaaactatatttcttacacaccttcttcaacaggtaagaagggttaaacatttttattttcataagcactcagaaatattaaaatcctgatttcatttcaacatgtcagactgaaaagtggtttgtaaacattttttgaagttatttgtcatacttaacagaaagtgggggttaactcctctaatcttgtttagacattaaatctgggggttgaaatgttgcaaaccaaagatgataatgtctttggtatatttataataactcaatatggtgtatgtctctaatttctaatttcagacagacatacacagattttagacatatatcatatatagtgtgtatgtgtacatatatatgtgcatatatatgtacacacacacccttacatatatgcaatctatgtatatatagatatatgaatggttatgaaaatttatttgaatagatacagataaatgcattctatatatcccagggaagtaaacttgtatttatatacaataagtcttcactcaatgttgtagacagattggaaactgcaactttaagggaaatgacataatgaaaccaatctttttctctcatcaccgttgtaacaactttgaatgaaaataatattactcaagaacttgctatgtgttgtttttcttaaagttgcaatttccaagaacctattgataacattgaggacttactgtgtgtatatatatacatatatatatgtatatatgtatgtatatttgtatgtatatacacatgatgttactgaggacttactatgtatatgtgtgtgtgcacatgtatactcccacattatatgttttaataaatcaactagttatgtaaattgtgtagtatattccctgtggagtaaaagtattccaggagattgatctagaatccctgtaaaaaacaagagtataattagctacaaaaatacgtttaatgcatttgtaaatttacaaaagtcaattctttactatttttgtatttttgagcaataaaatgcttgccattagccacattaaaaaatgcaaagctagacagcctgcaaagatagagggaagaaaagtgagagaaattcacccatttttatggaaatgacatcatgcccaggtctactaaatgctagttttaatgcatggcacattttacaagccccaaaactcacttatattttggaggcacagttacattttaggggaagggcattactgaatacaaaatgttcttttcctcctgctgaacggaatatagagtgctaacacgctttccagacctgctgcactggatgtagtccattaacaaaggactggttttgaattcatcaagtcctcctgatttttaagccatcgtgcattttcctgtcaaaaagatttggcctaagatatctatgctgaaatttgcactctgacaactttacatatcatgttggcttttatgtcatttgagtgaattaatcaatccttaagaactgaatgactcattaaaagcatttcatcaagaaaatgctaatattattccccttccatttcaaagatcttactataaaatgcttttacacagcattagttgaataatgcaaaatgtgatgcaaaatgtgcaaatgcagcaacatggaaatgcagccctggaaaatgtatacgccgccaaccaagatttacattagtaaggatggaatgttaaacataaactaccataaaatgaaaataaaaacttagaattgatcgttgctgttcttgttcatttaatgctgactatatcaaagaaagagggaaggagatcctaagtttatttttgggtggatttcctgattattaatcaaaacgatatttatcaaagtatatcttaaggtgattgtataaatatggtaacttctaaaaattagctggtgcactgtattaggactattttcggttgttttttacgaatatgtgccataaatgtaaaatgagtcaaacctcaagcccttaagatcataccaaagaatactgcagaattacagagattagaaaataaatttttttaaaccagaaatttattcataatttctgaacaccaattctccttattgctttcaaatggcatttggttaacatgataaataggtgtactctgtgtgtgcatgtaaacatgcatccacacacatgcacatatgtgtatgtagagtgttaagtgaactcaacagtcttatgttaatttaataaaacacttatactctttcacacacacatatataaaatttgtgcacttaattagacaaccacaattcaactttctgtttgcagacctaaatgtcaagtaaacaaagcatgaagatagcatattcacattctccaaatccctctgcatttttcaatacctcttcaagttctgttcttaatgttcctcctagaattttgcaggctaggtaagcgacataataattatcatagaaacctctgaaactgcatgggtcccaggccccattccagtttctctgatttgagacattctcaaagccttgcttgcttatatgaggtagaccagatacctcactgagctctggggatcaatcctattttgtccttctgggatcctcagctgaaaaatggaatgtcctactggccagattaatattttctacaagggatgccttgtgactgggctcctctctgaaaaataaaatgtttaaactacaaaatccctaataatacctttctacctaaagtaaattaagtgtattctactgtcagccaatgaaaaaccgttgtctattggttcctgtaacagatgcaggtaaaaaaccaccaagaagaattttgggtgggtcattattatttgaactgacacttggatgttatggtacaaagtcacttaagttactaatttcaatgcagtgcttagtgaaaggactggtttggctgtccatgtgactgttgcaatgaaccgttttaataggctttaggaatacaaggatggtggagtatgctggctgcttcttactgtgcactagagtcttaaagaacaaaagtcactcgttcaaaatattaatttcttagctcatggaatagtgagaaaattaagaactttattatcacccactttaaagaaaagctctaatttctgttgcccaggctggagtgcagtggcgccatctgagctcactgcaaccttggcccccctgggttcaagcaattctcctgcctcagcctcctgtgtagctggaattacaggcgggtgccaccacacctagctaattttttatatttttagtagatgggttttcaccatcttggccaacctggtctcaaactcctgagctcaggtaatctgctctcctcagcctcccaaagcactgggattactggcatgagtcactgtgcccggccaaaagatctaatttcttacgggcccagggttggtgtatctgaaattccagagaggagtatttaactgtgatttcaatgaaagattaattacagcttttctaagtctcttgtgaagttgatgaggagagtatgtgactccaggaattgtaatgcaaacctttcagactaccctgatgtatccttgctcatgaaaactcaggatactttgatgaggctgtccctgccttgtttgaagaccttgtaatatccttacctgatatattaccttacctgaagtatgttacctgagatgttacctgatacggaagtgcaaattttcttcatgccccacccttgtgacttcttgtggtctccagacctataatgagagtcagatcctagcaggctctgtgattacttgtatagatgaatccaggaagaagagaagtctatatcatagatgaatctaggaggaagagaagtctacaccatagatgaatccagggagaagagaagtttacatcatagattaatccacaaggaagagaagtctacaccatagatgaatccagaaggaagagaagcctacaccatagatgaatccaagaagaagagaagtacaccaaaatagggcactattttgcagttttgttttttttgttgttgttgctgctttttctgttgttgttgtttctgcggttttttttttttataatctgcaaacctggggaatatgtatggaaataggaatagattctaatcatgctagtcaaggaagacagaaaatagttataaattggttagaatttattttcacagttgcatctatgagagtagctgagagggtttttaactgtttgatctgttggtgatggaatcttaaataaacagatgtcagaaagcccctgcagcaataggaaagaaggaatcggaagacttttggtgaaagtttgggtagatctagcatgtgggatccacatatctgccatctttgttccccagggggggctcagcactttctccctttatcaaagcatcaagaaatttatgacgaagggaaaatcctgctccttgcaaatatgttcccttatctgcctttcttaatgcaggaaatgaaggttgtgtttgtgagacattggaaacgggatcactaagtcacgggaaacaggaaatgggcaagatcaagggagattgtttaaccactaaacattattagatgtggttgctgaagaggcatcaggcagtctgtggaccagaatgtttcatttgcagagatctttgttgcaggttaatttatcatggcatctctagggacccaaaagggaaagagcacatgttgttgtacaccatggagatatcaaatagggtgagcgggtgtttctcttgggccaccatgatcctgagttgtggacccataaccatatccagactacagttatttccagactaagaatcttttgaatagtgtccttaaagaccaagcccttgataacatccaaagcactgtatccaagtgatcggaagccattaacggaagtttatatgagaaaaaaaaactattcagctctttcaggatttataggtcattggctcagagttaagcaaatgtctctggtgacttggaatgtttctagggtagctgagtcagaataggggctcactggcctgggtgggggggtcacttaaatagaattgtgatgtgactctatctcacaatgagcaaaatagtttcaagacatcctgccattgtatctcatgtttctgaatatatattaggagtgtatatacttattacctgccagggacccccaacattggctttctgatcttcaagtgaggattatggcagaggacattccaggtgttctcctcttaccaaaatgacaaacccaaccaagaagacatccctgaaaaattaaatattggggccaccatcagagttctaacatagaaatctttgatctaagcctgttgtataaaattgtatcctccccaaaattcatatgctgaaattctaacccatagaacttcagaatttgactgtatttggagatggtttctttaaggaggtaattaaagtgtgatgaggtcatctgggtgagcccttattgaataggattggtgtccttagaaatgagagaaataggcagatgttggttaaggagtacaagcttttagttagttataagatgaataagttctggaggtctaatgcatggcatggtaactatagttaataatgctgtattatctaattgaaatttgataagagggcagattttaagtattctaaccacacacatacacacacacacaaatgttacctatggttggtgatagatgtgttcattaacttgactgagttaatcattacccaatgtatatctatatcaaatcatcccattgcacaccttggatatgtagaatttttattgattcagtattttaagatttataaaaggagatgaggacacagacatgcacagaggcatgaccctgtgaggatacagggagaagatggcatctccaagccaaagagagaggcctcaggaggaaccagccctgcccacaccttgatctcagacttccagcctccaggaccatgggagaatagatgtctgttgtttataagccccccagtctatggtattcagttatagcagcctgaaatggactaagacacctcgtaagaagaggagatgaggacacagatacacacagagggaaaaccgtgtgaggacacagggagaagatggcatctacaagccaaggagagaggcctcaggaagaaccaaccctgtggacaccttgatcttgcacttccagcctccagaattgtaagaagtgaatttatgttttttaagccactcatactttgttatggcagccagagcatacttttccaatggccatttaataaacctcttgggatatgcagaagatagatagattttaaaggtttcctgactagcggtgtgcttactcatgtgctgatcccaatattgtttctattccagatgtggttaatagagacactgggacttgggaagcatctatggatctaaggaatgcttttgatattttctcgccattctaatcaatagagagaaactgtttgagtgggctagttcaataaacatagcagcatgcatgcttattgattatccctctgcatgtgtctgtgtcctaatctcttttaaaattttaaaatacttaattgacacattaaaactgcatctattcaaggtgtacaatgggatgacttgatatagatatacattgagtaatgattaactcaaattaattgacacactttcttactccaaaggggatttgatttctacactatctcaggaaaatcatacttgcctttagcagggcgtggtggtgtatggctgtagtcctacttacctaggaggctgaggtgggaggatcacatgagcccagcaaggtgggggctgcagtgagccatgattgcaccactgcactccagcttgggcaacagagaccctctctctcttctctcaatctctttctctctctctctctctctctctctctctctctctctctatatatatatatatatatatatatatatatatatgcccacatttatatatatatatttatatatttgcccacatttaagattacattgtaccaagaggacctgttgagccagaagaagcaagtactttaaaagacttagagagaaatgtttactaagagtagaaaatgaatactgcaaaaattaagggatattccactttggtaaaatttttttggagtccactggttgtaatttgttcacttcatcttaagtaaaagaaaagatgctgcattttcaccctgcaggaggacactttcccaaatgactttggctgacctagctcttatcctttttgcttgcaacttttgggcagaatgtagcaagaatgcaacatcctgagataagaataaactattcagaacagcccaggcttttttcatctctcctagaaaaagatgtcctgcaatgcttgatctcaatgacccaggtgtttcctagtatataaaactcagaattgagttctctcgggatctctcagctgtggtgcaaagtgaagtattcacgcactcacaaccacattagccctggatggctttcttgagtcttaggatacccacttgccatgaatcctagggttctgttggttcttgctgcccatctgtgagtaataaattgttttacctgacctgtgctagaaattagtgtagcaaacttgggattggtaactgatgtgtggtgacctgcctctcgcatgccttgtttgaattcttgagacatttatttcatttgagagtactggtcctatccatttgtcttagcccattctccctaaatctacacctgtgacctcatgaggggcttcctataattatttgattgtggagaccaaattctcttctagttaattgatgttcctgcaggatgtgttggcatcagctggaagcagacagttgcagatttatttctcctttggtgatagcttttgggtactctggagaaaggtaatcttgcctgtggatttaatttcaaggagtaccacttggggctcatttgctaagaaagagcattgactatcatgatggatctactaatttcacttaatattttgcttaagtttgcataggatgttggtagggtagcctcaccatttagttcttagctcataagatgtcaatgtgagattatgatttacctacaagaggaacaagcaaaatccaggggaacaagggtatgcaaagaagtagagtagctaaagaaaggttctgagacagatgttgaggaccagctcatttttcaccagtcttagtctctttctagaggcctttcttcaacttctatatggtatggaaatcttgattcccttgtggccagattttcttatttttcccatattgcactctgtagatgtacccacatgacacttggaaagtggaattgaggaatgtgagatagaggaaggattgaggaatgtgagatgttggggttgaggtgttcgtttcctcttgggaagttaaaacggaggttctttgtggttaaaaaatatcttagtgtgaatttttcaaaggtcaatttccttggactggttattttctagaggaccttatagttggttcttctaccatgtcagatattcagatacttatttctatgtgagtgtcattcttgaaatgcatcataggacaaagaagaatgtggatacactcatttgtagtggcttgtccaacactttttattagagtgcaactctggtgttcatgggtccataaggctatattcatgaaaccaattcacttaaaatgctgctcgtgtgatatgtcaaagggaaaagagagtccaagacaaatgcatactcatttctactgattttataaaatgcactggagtgcaagaaacatctaaatgagcagtctacccttgcccttacctgagaaatgtctcgaagaagaataaagaagataagaggagagggaagatgtcgaaccaacggggatcatattgcataatgctgcaaagaagtatccgataaggggaaatctgcttgaatcataggtgcttccattgagagtctcaatgattagtatgtaaacctgagttcaaaaagaatcagtaaagaagtgtaaaatagtactaaggtctgttgcagcattgaaggaggaaagttggacataatccccctgcaggaactcagacgatatacattaaggtttagagagaactgaagttaatgcttcagaacacctgggtttgtgcaacagaaaagataagcaaaataaacctctgtgcacaaagcaaagtgtcatgaggctttttgtaagaaaggagataagcgcttcttccttctccatagatatcaaaggccagagtttgctttatgagaacagggaagaggcaagtcaagtaaacaatctcttgtatgaaacacatacgttggaaaaaggagtgagtccgtggaaagagaactaaggtctaaatggaccctcatgtttacagagatgataagggaagatactcaaaccaaaaaagagccatccctaaagaaattattgaagtagaacatattgatagaaaagagtttacattctatgtatccgggtcagtgaatcgtggttgaaagccaaagctaatctctgcaaggatagacactcggtttgtgtagcggcttatgctgaacttgaaggtgaccgtgtgacagggaagtcccagggatagaagatggcagagccagtgggcaggtgtaatttccttggtctaccagctgggcactgaactttctgctatcctcccttccttgagcccaaatgtgcctggcaggatctgagcaccaaggggaatacttggcattcagaaagaaatttggccttggtggcctcccaagggattggttagaatacctgtagctcaggtagtctgttcaaatctagttttggccccaaattcagggacacactcctagtcattgaggtgcatgtagaatagatattgttctttcatcactggttttttgcaagtagtttctggcactgggtaatttcctttctggtaattgataatcaaagagtgtcagtagcaggactggaatagacaaagacatgccgtgagatgaactggttacacgataacccttgggaccaatcactgatggcagaaaaagcaacagaacactacgacccttaaatccaggttagaagagctcctgtactgagccttgctttcaaggactaaattctgaccttcctccagccacattcatctgtggaaggactccaagatgtcaaagctctatacctcagtttagaacccactctgggtatctagggccctggacttcccaacccaaatgactctacacacacttccagaattagcgtggcttgttccctaagctgtgcctgtaaaggacacttctattcagaggagtggccatgtggtggttgctggaaagttagaataaggacttgtgttgtgggtgggtgagcagaatctagatgcccttgtgggaggaaagatggaatatggacacacattggagaggcagattgaatatgggttcatattggggaggtggatcaaatatgaatgtgcatgcggggatggatggagcacaaatacccatgaagaatgaatggaatataatgcccattgtggggagggatggatgaaaaatagacatgcattgggagagtggatggatacagatatgcattaggggttgaatgcatacagacgtgttttaggaggcagatgaaataatacagacatacaggctggggtctctactcatgagtgctggaggagcttaggagatagcctgggcactggaagagaaggggatgggtctcaggcatggccagttcctcaggccctctctccagttcacctcccccattccccacccagtctgtacctgtgcttccaggttgttataaaggtgtgttttgttaaaatcgaaatacaaaatatacatcattttacccatttgcttggttataactttaaaatatgcagacatagattaggtgaattgccttaggactattgccctgggtttgcaaaataaaaagccaagtttggtcaggatccaagtctaggacctccaaatccaagttctctgcgtgctcactcaactgcctctcagaaagaaaggagaagatattggacttaaaaaggaaggagaatgatgtcttcattatgtattattatgggatggcatgtcacatgttttctgttatggtattgcatgctgtcatatttgctgtgctatgctgtgtcacgtcagattatgctatatgctgagctgtgctgtgctatggtaggttctgtgttattctgtgctatgtgatgacttatgctatgctcttctatgctatgctatgttaggttatacgttatgctatgttacgttatattttatgctatgctgtgctatgttatgctgtgttatatgctgttatatgttacgttatgctgtattatgttttgttgttatgctgtgttatatgtcatgctatgctgtgctatgttatgttgtgttatattctgtattatatgttatgctgttatactgtgttataggctatgttatactgttatatgtcatgttatgctatgctatgatttatgctatgctttcctatgctataacatgttagataatttgttacactatattatgctgtgttacatgttatgctgtgctataccgtgcttagtctatgatatgttttatgctatgatgtcatatgatacattctggtatattatactattatttgctatgttttatgctatgctatggtatgctatgctatgctatcctatgttttataccatgatgtatgtgttagtgaaatgggaaaggttcccttgtccccctcacagggtgtgcaatgggggtgtggctcatttcttcagtgctccactgctcaaatctctaggggagcataaagacaggcaggctgtggggctccgaccccatggtagtgtctgtgccccagtgggtatgtgttacagggtgctcttttagtttgcctataggcagcttgtgttaaccagcttaattagaccctctaccttgttgcaaggacagggctttctctatcccaggttcttgtctttgtgtaccggaagaatcagatcacacgtgggcttggagaatgagtgcggttttattgagtggaagtagctctcagccaatgggggagccagcagggagatggttttcccctggatttgggccgctcagcagccctggctctcctccgactgccccagccaatcgtcaccttgtcctgccggtcaatggcctgcccgtgtgctggtgcctgtcagtgtgctcttctgcgggtatgctcctctcgaggtcctcttgatgaccagccacttgcatcttcttctgccggtgtgctcctctcgacatctggtcacttgtgtgctcgctaggatctcgggtttttataggcccaggatgagggtgtggcgggccaggctggtcttggaaaatgcaacatttgggtgggaaagcaggagtgcctgtcctcacctaggtccgtggaggtggagccctagccagggacccgcctttctatacccagcacttcccttcccccactctgtgtcatttaaagtgaccacgctcttcccttcccagcactcccatatcatttgctttatgtttaatgctatgttacatgttatggtaggctatgctataatatgttatatgttagttatgctgtgctatctatcattctgttttgtgtttttctatgctatgctacattgttttatgccatgccatgcactcttatgttatatgtcacgctgtgctaggttatgttgtgctatatgttatgccaagctaggctatgttattttatatgctatgtgatgttatgttatacattatgttatgctatcctatgctctgttaggtgttgtgctaggttatgctatgtcgtattacgtaatgcttgttatatatgttatgtgatgcatgtcaggttatgcatattatgttttcatatgcaatgtatgttatatgatccacattatataatgcatattatataaagacagtatttaaaggactttgaggtaatcaagggcaagtaaaaatggttccagagaaggaacaacgagacttacaaccaatacagattcagggattcctatagattctaggccaagaagtagagcagctggaaaagttttatttatgatattacaggaaaaccagttattttctcacaatggatgaggaaatctaaggctgcatgcaagagataactttatatctaacaggagacagaatcagggaaagatgtcaaggttatgaagaataaaaacgaacaagttcagaacagaccatagcaaattaacaataatggaagagtttttcccttcaatgtattcagagaaaagagaaaattgacactgtaaaggaaggctcagaaaaatgaaatatgaagtgacatctattaagtaaagagataacctttcctgcaacattatgtgaaatcatattgggatcagataaactggcaagggtagtcaaggatatattttgccaaatttttattctacaataggaataataatgtctaaaaaagcagataatccgctgagatcaatgaggagggaacacagtgaatgcaagacggtaataggaaggcccagttatacttaaatagtttaaagactgtgttaaaattatgatgtaaaaaataaagttgtggctaggcacagtggctcctgcctgtaatcccagcactttaggaggctgaggcaggaggatctcttgaggccaggagttcaagaccagcctgggcaacatagtgagaccccatctctaaagcaaaaataaaaataaatcagccaggcatggtggtgtgcacctgtagtcccagctacttggaaggctgaggcagtaggatcgcttgaagccaggagtttgagaccagcctggacagcatggcaaaaacctgtatctacaaaaaataaaaatagctgggcgtgctgacgcatgcctgtacttggaaggctgagggtgggaggattgcttgaaccctgagatgtcgaggttgcagtgagctatgattgcaccactgcaccactgcaccctagcttaggtggcagagtgagaccttgtttcaaaaaaaaaaaaaaagaaagaaagaaagaaaggaaagttgtgaatataagttcttttgctaggttcttgggaaaataaaatacaatatccagcatagcagagatagctaaatgaattacgtgatactccaaatacagaaacacatgcactaggttgattacattgtttttgccaatttgatacaatggatccctttttattagtgaatggcataataaatagcatggatcagttttcttttgattttcatgatatttcctgaaatcattggctgtaactcctttagaaaaagtagtcattaacagactcagagaaagttctttttcaacctctaataaagaatatcaagcattggatacagaattataaatgttggtgatgcttgtttaaatcacaatgcttgctgcatttctgtttatcagaaaggcaaaccattctggtcgcctttgtatattttgaagataaaggagtgaaaaacatgaacacaccagagttgagactatattaaaatcacagtattgaatattatcctttctttctccgccaaagaaaatgattctttgaagccatccagccttataagcaaatggcactaatgtgctagggtttaacggagaagggacatcattaaatggtttgttatgacctaaatgaatgtcaaggaaagctccgacttctttcgtggctcagtgatttctcatccaatttctttctttttaccttggcagaatgacagctcggtacattgttttccctctcatcaccttcatctcttgataggcaaaggaatttatttttaaacaaaggtcaaacaaatgacaagctttggatgtctggtcaggcagaaaatatatgtagataaatagacgagttgcacgacaattcttaggcaaaatatttcgggaatctgaaaatggcaacggtaatggaaagggtaacaagcttctaacacttgctgaatagtctttaaatgctgacagtctgtggtgtcctaaagcccaaatatgcaaatagggccaacatctgacgttgtttttccactaatgagcatatcttccctagtaaggatgcctgtgtcagcacggggcatcttattacttcttgattctgggcaaagcctggttttccaaggctccaagaattccacatcttttctggggaaattgagggtggaggaacctccagggtgattcaatcacacatggcatccttgtctccagaggaaagaattgtgtggtccatttatctttcatctacacaacaacttgggaacaaatgggtgtccacaatcagctgctcctcttaaaatacataatggaaaatatcagcaaacttgcttatcagcccctaaaacccgaacaagccaagccaccaactgcacattggaagacccaatgctgactttgcttttttttctttttgcttgctgttgacaaatttgatatattttcagctttctaaggaatactggatattgcatctttttcttcactagcacacaatattgctttttcctctatctacatcattttgaaaggcagtgtcaaatatatgtttgtgatctatttattatttttaaagttgaggggaagtggaagttttaaaatatattaaaatatattttcactgtttttaataacactttaattatttttaaaattaaattttacaagataaagggaaatatcttcccaaattactatccagggagaatcatatggtgatgatatacaatatgcattgcaaactaaatttaaaattaaatatattatgcaattcattttgttgaataaatgcactatgatttagttaattcttctctgttgtcatatgtttagcatgttttttctttctttcggcttccctccctccctctctctcattctttctctctctctctttttggggggtgggatgaaaacgaggtcttgctctgtctctcaggtctctcaggctagagtgcaggggtgcaatcatagctcactgcaacctcaaacttgtggactcaagtgattcccctgcctcagcctctggagcagctgggaccacaggaattcaccactacatccaactaattttttgtagagacagggtcttgctaccttgcccagtctggtcaggaactcctgggctcaagcagttctctcacctcagtctcccaaagtactgggattacttttttctctaagtcttgctataacaaataaaaaacaagtatatttgtacatgaatattctaaatgttgttcagagattttcttaaaataaatttctaggagtacttttactggataaaatgcatgatatttaatttgttgtggtatgactcatttaagtattttgctttctagaattcttccatttattaagacctgacttgccattataatttactttaactgtatctgcatgatgggagtaaacttttcttttgaaaataattttaatatgaaatatgtttgaaacatacagtactatctagtgtctagtacaatatttcatatgttaacaccttatgaatactccacatagctctgaaatgtctgaatattttgaagtggttttgtaatcatcttcttcattcatttcttaattttaaaattgctttatctccatttttgagatagcttttgtcaggttaagggaatttttttagtttgctaaaagtttctatattaatcatgaattatcattaacatttgttgaatgctttattaaattatgacttttgtcatttattctgtggatgtgacagttcatactcatatattttttaatgatcaacattcttgggtttctaggataaatccaaattgattgtgatggatttttttttgacctagctgaattcactttcctgttttcatttaggatatttacagtcatgttcataagtacgttgttataggtttcttataagaccctggcttcactttatgtattctattttattaaaaaaatattttcagtgcaggttataatgttctcataaacgtagatgaggaaatttaccactggggaccctgatgggaaacagatggtgtacttaaaaggtaatgggatggagttgattgagaggaatgtttatcagggtgtgagggacccaggttcaagcatcaccaagacattgatattttgttgcttcagcctgaagcaacacaatgaggaaaaatcaactggagcctactaatgatggagtagagtttcataggttgatgtcctcacaaccaggacctcagaatgtggctgtatttggagatgaggtctctaaagaggcaattaaggtaaaatgaggtcagtagggtaggctttgatccaataggactggtgtccttataagaagaggagaagaggacatagacacagacagagggacgaccctgtgaggacacaggaagaagatggcatctctatgccagggagagaggcttcaagagtttcttcctataagggcaccagtcttattagattagggcaccaccttaatccagtataacctctatttaacctaactaatttcctctgcaactgacctatttccaaatcaggtcatattctaaattaccagggcttaggatttcaacatctctttgtcttttggggttgaaggagacacaattcaactcataatattgctgtagagagatgtggaaaaagtgtttttcctattggctggtcgaatgtaatttcaggttcctgagaggtggaactggggctgaggaagtagagagcatagatttctttgggaaagacctaaatgttgccttctgtctctatcttgcctccagctgtccagaaatgagtgttgaggtcacatctagagccaagtgggactcaggaagtgtctcagttggacagccttgtgccctgagagaacttctaaaaggcagaaaaagaagtggataaatgaatacacagcactctccacctcatccctctccaataaatgtgggggaaaaaaaaccccaaaaacttgctttttaagctatttagttatagcttagagctagcaatatgggccatgttgaatagtagaagaaaactgtttttatgttcttgataaagtcagcagagttgtacatgctgtctgttcacttttgcttagtcagatggggaactttccagaattttctagaactttccagaaccttccagaagagtatgctaaagacaatggtgtgtgtctgacttcattggccatttttctcagaataaagccagtgaaagcaaattaaatgtatacagcacacaccctggttttctttggattccaaaatattaacttcatttgtatggtatagctaaaaaatagtgtttacagtcataacacgattatgttttgaaaggggaatatgagccttagaatatttaatgtaaagtgttatagattgtgtttttttattaatgacttttctcattaaaaaaaatttccaaagaaagggtcacaatcctctcagaagggatgttggtaatacatttgtaattatcttacccatactaattactttgaaatcaatgaggcagttcctcttcattttatagtgtatttaaacattctagatcattatacattttatgaaatttcatatcccatgctgaaattttttaatactaacttacatttatacaacactttaaaatttttattactttgtctcttacgctcatttgattgtcacagtaaacctattaaatattgagaccctttacttctcattcttctttaagaagcaagaaactcagggccatgtttttttcgaggttaaatggtcactaaaacaactagctttgtctctttaattccaaaagggtgtacgttgtactgctgggttttttcctctaacatttcaagcgatctgtatgtttcagaaaatgcacatccagatccccttttgagagtgagagatatcgccatctctccctcgttgatgattttcttggtgttgtccaaggtcaaatcctcaacagatatttctgagcagaaaaagctatatgagattctggaacacatcccagaggtcagagtttaatttctgctttggactttggcttggagactgggaaaggggatgggtgtggaattttctaagcagtctcgtgtaggggctgaaggtggtggagagttcaggaggataaaaccccgcaaggaaacatggcatctcaatggaatgaatgcatagaatgaagcagcgtgctggctctctggaaggcagatgggcatctggctcaggaatccagatggaattattggtccggggtgcagaggtggcatgtttgtaaatttagctggaagaggctcaaagcaaaattgaaacagccagacattgtccccataagtaggaaacagcagaatgtggatgcatctatggtgatctctatagaattagtgcaagaaagttctttgaataccatgtataagaaaatgtgaaagtgtatgtgtgtgtgtgtgtttgtgtgtgtgtgtgtgtttgcatgaaattctgatttcagtatgcgttctctgaaataaaactcagcacccttcttggttgagtgattgggaataaaatagaaaagtattagtgagcatcaacgaatgtaaggaaattgagtgagggtgaggctgaagggtgtgaagagtaagggaagcttttcaagatttatcaagaggttatatcaatgcctgatttttgtgttgaaaatgaagacctgcttatgaacatgtagtgttgttccttcccccgagacattcttatttttccttttgagttaacgcgtaatacctatacatatttatgggatacagagtgacttttccatacttgtgtaccaggtgtaatgatcatttcagggtaattagcatattcatcaccttaaacattttttttgtgttgagaacattcacaatcctttcttctagctttttgaaaatatatgataaattattgttaaccatactcatcttcagtgctttagagcactagaatttattcctcttatctagctataattttgtatccattaaccaacctgtccccacctcccttctcttttcccttcccagcctctaataaccaaaattctctctacttctatgacatgattgttattattagtgtatgtatacatgttattataaagaatactcatgttttcttcagttccaaagtcttccctcatttcttcttatttgtaggaactgttgttgtaataatacaatatgatgtcacaagtgctatgggctaaattgcatgccctcaaaatgcatatattgaagtcctaacaagtcctaatccccaaaacttcagaacatgactgtatttgaagatgtggtctttgaagaggtcattaaggtaaaatgaggtcactagggtggaccttgatccaataggattggtgtccttataagaagaggagattcggatacagacacacacagagggatgaccctgtgtggacacagggagaagacagcctctacaagccaagaagagaggactcaggaggaagcagccctgcccacactttgatctcggacttccagcctgcagaaccatgagaaaatgaaatcatattatttaagcctcctagtctctggtattttgttgttggcagccttgggacactaatacaagacatttcataatatactgaagagaacatagactatattttaactattaattctcatttttaaagagcttatctattgatgcaaacattaactatagtcaccaatatatacaatttttgtcataatctcatttaagtattaagttaattaaaaacatattccactactagccctactcatttgataaaaatgaatgttaagggaaaaataagacattttatatattacaaatgtatttttttgtgtgtgtgtttttaccagctcagtgtccaggaaagacttcagctccatttctgagtctaattccaactgtggtgagctgtgtggtttctatttagctacagttgaactttctgaactcaactggtctacttaaaatgtcacattttccatagatttgctgtgatcttgggctgaccacagggttaaagttggcccttggatatatggaatcctcattctagaaagttactaatggaaacaacgaactagtatcaccactgaaatattgttttgtgagtttcaggattttaactatcctcttaaaacgttaggatagcttaaaaaaaagtggcattctttctatacagtagccattggatcatcactgtcaaaattcatctaagatgataacacctgattttgaggacatatacacagcaaagttaaacatcatatgaaatgttgtggatccaaaattggcacccaggtattttgttttatttatcgtaagtcactcattatttattctaagcatactcattattctaagtcactatagtagtataaatatatactataaactggatagtacatatccaatattatatatatattagtatatattatgtatactaagtacactatacttatatatacatagtatacacagtttatatgtgtattgtatatataatatatatgcaattttcatattttacattcttacattcattttacatacatattcacattcatactgtaatgtgtatgtgtgtgtgcatgtgtgtgtagggaagggtgtgtatgtacacacacattatatatagcatatgcaatatattatatatagtatatagagtataccatatatgataatatatagtattatgtatatataacatacatattatgtatgttacgtacatattatgtataatataacatatattattatatattatataatatatattatcatgtatggtatactctatatactatatataatatattgcatatactatatataatgtgtgtgtacatacacacccttcccacacacacacgcacacacacatgcacattacagtaaacccccatttaacattgttgatacgttcttggaagctgtgactttaac[136 bp omitted]catggtgaaaccctgtagctactaaaaatacgaaaattagtcaagcatggtggcgggcacctgtaacctcagctacttgggaggccgagacacaagaattgcttgaacccaggagaacgaggttgcagtgagctgagattgcaccattgcactccatcctggatggcagagcaagactgtctcaaaaaaataatgataaaataaaataaaaatagaaaaacaaatttaccataggctaattgatataaataatagttaagttcctatgtcatacaggatgtcattttgcttcagtgcagtttccaaggacctatcaatgattttaagtgaggatttactgtatatatagtatatacatatagatagatattatattatatatgtagtaaatattatttcatatatccagagtgtgttgccttgtagtaacaaaatatatactatatttatagtgatatataatatctatagtacatgtagcagtatatataatataatgtatatgtatagtagatatatattatagcacagtatataaatggtatatgtttgtatatatccatatatgtccatagatatatagaaatatacagtcatgcaccacttaatgacagggatatgttctgatgaatgtattaggcaatttccctgttgagcaaaaatcatagtgtacacttacacaaacctagatagcacagcctactacccacctaggttgtaaggtcaagcctactgctcctaggctacaaacctgcacagcatgatactgtactgaatactgtaggcaattgtaacacaatggtaagtttgtatgtatctaaacaaagaagagacacagtacagtataaaagataaaaactggcacacctgcgtagggcacttaccatgaatggagcttgcaggactggaagttgctctgggtgattcagtgagtgaggagtgtgtggatgtgatcacctcagtcattactgtgcaccactgcaggctttataaacactgtacacttaccccacactaaatttattttaaaaatagtttattttcttcagtaatgaattaaccttagcttactgtaatttttactttataaactttttaattttttttacttttttgactgttttgtaataacatttatcttaaaacacagatacattgtagagctacacaaaaatatttttttttcttctgtatcagcctcgcaagtagctgcaattacaggtgcccgccaccacacctggccaatttttgtatttttaatagagacagggtttcactatgttggcctggctagtcttgaactcctgacctcaaatgatccaccaacttcggcctccgaaagtgctgggattacaggcatcagccaccatgcctggcccctcaatattttctttctttatatccttattctatagcttctttttctatttttaaatttatgtatatatttatcgatttatgttttactttctaaactctttggttaaaaactaagacataaacatgcccattagcctaggcttacacagggtcaggatcatcaatatcactgtcttccacctccacattttgtcccactggaaggtcttcagggacaataacatgcatagagctatcatctcctatgataataatgtctttttctagaataccttctaaaggacctgcctgctgctgttttacagttaactgttttttataagtagaaggagtggccagacagggtggctcatgcctgtaatcccagcactttgggaggccaaggccagcggatcacttgagctcgggagttcgagaccagcctgggcaatatggcaaaaccctgtctctgcaaagactacaaacaaaaattggcttggtgtggtgacatgggcctgtagtcccagctactcaataggctgaggtcggaggatcacttgagcccaggaagttgaggttgcagtgagctaggattgcaccattgcactctagcctgggcaacagagtgagattctgtctcaaaacaacaacaacaaaaaaaattagatgtacattctaaaataacaattaaaagtatagaatagtaaatgcataaaccagcaacgtagtcgtttatcattatgaagtattatgtagtgaacataactgtatgtgctagacttttatatgactagcactgcagtagttttgtttacaccagcatcacctcagcacatgagtaatgcaagactttagaacaattacaaagtcactaagcaacaggaatttttcagttttattataatctcatgggaccagtgtaatctatggccaagatgttgttatgaggtgtgtgactgtagatatgtttttatttttattttatttatttattttttgagaccgagtcttgttctatcacccaggctggagtgcagtggcgtgatctaggctcactacaacctccacctcccaggtttgagcgattctcctgcctcagcctcccaagtagctgggattacaggtgcttgctaccacacctggctaatttttgtatttttagtagagatgaggcttcaccatgttggtcaagctggtctctaactcctaacctcaggtgatccacccgcctcagcctcccaaagtgctgggattacaggtgtgagccaccacacccagcctgtagatatgtttttaatcaaatattgttttgccctaatttcaggaagcagtttattttaatacaaaagatattaaaatatttgaatatctccagcatggcatgcacccatgggcattttagacaggcagcccctcaagggggttgagggctgaaccttgtgccctgggctgggcgggctgggaggttatctgagatggacatcttatccatggcaaaagacataacttactgggtctcaatatcttcatctataaagtggggatggaattatttcttgtctccagagggtgttgctttgaagtaattaaataatactcctctataattagagtgtgctagcatgtagtaaaagttcagcgcacgtttactgtattattttcatcaataatttgaacaaaaccatacagttctactcagccatccctcaaaaataacttcaatgccattcaatattttaaatcttcaattgttagctgtatgctagaaagtgtgataacatcgggtacataattgtaaactgtggtagctttttttttttttctttcaggaaattttaagggagggtttctgaactgcagaactgctgatatttggggctggattctttcttgtggagggccatgatatctattgcaggggtgatatgattggaatctgtgtccctgcccaaatctcatgtcaaattcagcaagttatcatcacctcttttcttttttgtctgcatactttccatgcattaaggcaaaaaggtcatcaacatatccctaaccacactctaaaaaaataataattaaatgtcactaatcacaatgcaataaaattatatattttcaacataggacaaacaattaaaaatataaaccctctgtattgagaattaaatagcattcctccagataaatgattaggctaataattaaagcaaaactttaattagaattttaatcaattagaaacaagcattaaagacaaattcatataggaacctctaaggaatggctaaagtagtgttctgagtaaaagctccatactagaaacatttatttggcatcaagaaagaatacaaatccaatgaattatgcattgaacttgggaaactagaaataagtaaagcaaaaagaaagccaaagaaagtaaaaggagggactaataaaaacacaaaaagaaaatgagaacatggttgttaaaagatttggcaaaaggatttaatttctccctcaaagcaacactaattaatcctgctagaattgcattttcattctgccataatagctggatctgcatgagttacagtgaaaatgtttttgttgttgatgtaggatagaaatcaagatcaaatccagggctggaaggggtggctcgtgcctgttatcctagcatttggggaggctgaggtgggaggattgcctgagcccaagtggttgaggcttcagtgagctgtgagtacaccactgcactccagcctgagcaacagagcgagactgtgtctcaaaaacaaacaaaaactcaaatcctggaggggccagtgcttagttagggttagagtcagggaaggcttttttgggcttaaattttggcttcaccaatcatgagatacagacattatttactattcctgggtctttgttgacaaacagaaagttcaggtatattgtgtccataggtcagctgatgcataagagaggttgatgaaggtgaaatactagtataccaagattaagaaaataatattctttaattatatatatatatatcacatttttaagaggtcctcagggtattaactacccaaataaaggtgatttccatcaagggctagaaatctgtctggctgaatggcatgcagtaaatcaaatatcagagtaggaaaaatggaatttatacagcctggggaaggaacttagcagtcatttaaaggggaacataaagtgtgtggtgaatgctgctctatgtttttactgtgggaattcataaaaggaagcaggcttaaaatattacctcccggaggctataacctccagctcagatgtaaaggaaaagagcattttctctcctcccgtgagtcccgtagtggtgccaatacacatctcaagcttgtaggtggccataatatgtgaattaaatggtctcttcctgatgtttgcctttggtgtggtcacgtgaacatggtatcttgggaaacaagttccataaataagcgacgtttgggttttggttagggtaggatttttgtgcttaaattctggctcaatcattttgttcatatgcttcaaatatttcactattttgttcgtatacttccaaaaggatttgaagtaacttattacaaattgcaaattagaaatggactgatattgttaaatgtgaatggaagaatgaatactgtctaaatagttaaataactctaactaatatgtactatgatggttaattttgtatgtccacttgaccagattaagggatgctcaaatagctggggaaacatgatttctgtgtgtgtctgtgagtatgtttctggaagagattagcatttcaatcagtagactaagtgaaggtctgccttcaccaacgtgggtagatgggtattgtccaatcagccaaaggcccaaatagatcaaaaaggtggagaaaggaaaaatttactcctagcttgagctgagatatccatcttctcctgcctttggacatcaaacccctctgttttcaggtcttcagacttgcgctgtaactacaccacctgctttcctgggtctctggcttacagacagcagactgtgggacttctcagcttctcaaaccacatgagtcaatccctcataacgaatatctttctttttaaaattatttatttgtatgaatttaaggggtacaaatacaatttgttacaggcatagactacacagtgatcaagtcagggcttttaggatattcattacccaacaagtaatttctcatcctctactgccctcctaccatcccacccttccaagtctacagtgtctattattctactctctatatccatgtgtacaaattttttagcacccacttgtgagtgagaacatgtggtatttatgtttctgtgtatggcttattttacttaagataatggcctccagtgccatccatgttgctacaaaagacacggtttcattcttttttatgactaaatagtgtttcattgtgtgtatgtgccacattttctttatccagttctctattgatggatactgaggtggattccatttctttgctattgtgaatggtactgcaataaactgttaagtgcaggtatctttttgatatgtttatctttatatattctgttggttctattgccctagagaatcctgactaatacatgtatctaagtcatttgggcttatttctttttttaaaagaaaaaagttgtatttttatcaaaagcaaattttacaaacccagcctatgcttaaagaaaaagatcatgaacaatgatcacaattggaaaccttttactaggcttttcctgggatgatgcagcaggcatactgtccacctcaaggcacttgactatagtgagagccatggccattggaaaattgtctttgcaaagtgatgtttatgtttgcagattgaaatccactctggcttctgctctctggttctcaggcactctcagctgcaacttggtctgtggctcactgctgtctctgagtcctgcaaggctgctgggccagtttgatgtctacagggggtctaggaggctgctgggtactaaagaccaggtgggagggagtcttgggttcagagctcactgcccctttattgcaggaactgcactgaagagttcagaagtgttaggggctgatgctccttgaggataattttgaaaatacgggggtttctgacaataataacttattctctgcttttccccttgagagagtctttggtagccagggcttcatgaaacctctatgaagagactgtgctctcagcttgtcctgaaggtgtggccagctgggtaatttgcacactgagattcacctctctctccccattgtacttcatttgcccctcacttttcttccctggaattgcatttgctgaaaatgtgttcgtacacaagttttattgcctcaaattctgtttcctataagcctaggcaaagatgaagttcttttgtattttttaataaaaatgtaaaattttaataataaacctataaaacataagcaaattgaagaaaaatgcataattacatatatacatacgcatacatacattattttatatttatatttatatatatggtatgtacactaacctcatgtgcaataaaaccaactaaaatagaagaatccaggctgggcgcagtggctcatgcctgtaatcctagcactttgagaggctgaagcaggaggattacttgagcccagttcaagaccattctgggcaacaaagggagaccctatttctacagatcattaaaaaaaaataagggctgggtgtggtgggtcacacctgcaatcccagcacttcgggaggccgaggcaggtggatcatctgcagtcaggagttcaagaccagcctggccaacatggcgaaaccccgtctctactaaaaatacaaaaattagccaggcgtggtggcaggcacctgtaatcccagctacttgggaggctgaggcatgagaatcgtttgaacccaggaggcagagcttgcagtgagccaagattgcgccactacactcgagcctgggggaaagagcgagactctgtctccaaaaaaaaaaaaaaaaaaaaaaatagccaagcatgttgtgcacacctgtggtcccagctactactcaggaggctgaggcaggaggattgcctgaactcaggaggctgaggctgcagtgagctgtgattgcatcactgcactccagcttcagagagagaccctgtcccaaaattaaaaaacaaacaaacaaacaaacaaataaataaaacacaagaatccttatgtccagattgctcaggagaagatacaattaaaataacctttcatattaaaatttgggttcttccaaaaggcaaagatcaagctttaattttttttctttgtatgtagatgaatctgtgatcctcagtgggaaaaattgagagtttcaacatgaagtgtttttatttttcctctgaaacttgctttttacttagaaaagaagaagtcaaaacttcataaccatacgatgagaaaaacaaagacaactgctaacgattgtttatctactttctgttaagtcagctattttcctagccttatgaagggtaatttttatttctgaataacattcccatgactttgtatcaaaagcccccagattatgcaagcacttatgtttcttggcctcattttttgtaaactattggaaagagatggccacttctaaaacttgtcggggcatatcatttaaggctatttgtttactgtggttttaaaaaataaaactcaagaaaaatgtaaagcttctaaatttggtgtattaagacacaactagttttatattaaagttatcaataaagaaattaaaatggatttcaattaaaatgtaactacactcattagagtgactataatcaatgacagaaagtgagtattgactagaatgtgtagaaattggaatactcgtatatggatgaaatggttcaactgctatggaagacaacatagaagttcctcaagaagttaaacatgacatgaccatacgatcaactcagataatcctgagccatctacaagtagcagaaaagtaaaaggaaaagcaaatgcaagaaagtctcagtgaataataaagttgctacttttaagttagcaagaacttcctgatagaagttagtagagtactatttagggataaaatcacatatagaaagagtgtttcctagttcctagtttctactcccaggaaggcatgggcttggctgtcaaccatgatgaaagaaaatctagacttcactttcagagctggaacgtaaatgaatagctagtgatggccgaataaatgattaagcaatcctactcataagtatatacccagaagaattaaaaacagggacgcagacagctccctgcgcacatacactcatggcatcattgttcataatagtcaagagatgcaatcaagccaacgtccttcaacagatgagtggataagcaaaatgttgcatatgcataaaacagaatagtattcagccctaaatagtcataaagtactgatgcatgtcaaatgtgtatgaacctcaaatacatcatgccaagtgaaagaagccagatacaaaagacctcataatgtataattgtttgtagaaagtatccaaaataagtcaatccatagagacagaaagtagattataattgtcaggggctgggaggaggagaaaggactaggaattgaatgctaacggctatgaaattcattctggagtgccacaaatgttgtggaactagagagaggtgattgttgtataccattgggagtgtattaaaagatagttctaaaatatgtaacgcaaaactcctttcattattttctactctgtctcccttttcccaatagggctgtataagtaaagaatatgcaaggcagagcagtaaactcagaaaacattgaaacatctataactagcatgaaaataaaataaaaagcaaacacaagaaaatgttggtgaataacaaagttgctgcttttaagttagtgggatttccctgatagaggtcagtaaactattatttggggataaaatcacatacagctcagaaagaagtgtttcctagttctcccaggaaggcgtaggcatggctgtcagctatgatgaaagagaattccagattttgctttcacagctgaaacgtagataaatagccagtgatggccgtataaataagaagccagtacctccagagaaacacacacccagacaggccattacgattcaccccatggttctcattttgctgtttggacagagtctctacatgaaaggcttgtgtaaaaagctattgatattgccaccacggcagggcagcccacctgcccatctcgtcttatgcatcaccactgtgaggactctgatgtgaattccaatcaaattcatgatggaaaatcactcagggctggggattttcccatgcttgatattaacccaataacaccataacctgtcactgcaatgaatcattgacaaattacccagcatgtgctgttgctttcttccaaacttgttttataaatagcagatggaaatgcttagtgggttctcactggatacgttgtctctgtgcagttgactacgtctgaagtctttacacagagggttgtgctctgggaaactggtaacccgacgcgatcccagaggggaaaatgaaggtacagcagccctaaaattacagatacagttcgaagaaagagatttcttttcctttagaaaacacttgatttcagagcatgcatccatttccagtctaacccaattcatcagaaaaaatagctctctgaatatatttctgactatttcaatgtggattccttctattgttaagaagatataatggtaagtttgtttaatattcatatattaagtttttcaagaaggacaaaaaagatgaatatgttgaaacatataaaatatctattttgctcttccagaaatattccctaggaatcagaaaaatgtcttttcttttattcactgtattttctattctcacaagtgcagcatatgtagaatgtggtggtggtggtggtttggttataatctctagggagagacttcacaatgtcccattaagctcccagaggctaaggttacctggttaagaggcaaaatgaaagatgagagtaaaatctgcctgtaatccagttttgtaaacaacttaattgaggtaaccatgataacacgtgaagtttgtttttctaggtctgagtttctgtccacctgaagtttcaaagctagatgttgttaacatagtaaattaagcagaatcggaaaacagttgccatagtatggcatgggtggacactttcatgagctgataacttgattcgaatatgtaagcatgttaaaagtctgttttccacataataactgaatctttcacataacctggatgaaatgagatatactaaatacatcaataaacatcaacagcttatttacaaaacagtcagctgcactgcagcagggattcctttccttaagattaattttcttctgctttgttttcaatctcctttcttggtgacttatctcttccatggagttgctgaaaagatttttatttacgtatgtatttattttttttcaacttttactttagtttcaagaaatgcatgtgcaggtttgttacctgagtatatagcataacactgaggtttgaggtagggatccaggtagtaaacatagcaccaaataggtagtttttgagtccttgcccccatccctcccaccaccctctagtattccccagtatctattgttcctatctttatgtccacgagtacccaatttttagttcctacctataaacaagaacattcaggttatgttttttttttcataaacgagaacatttggttttctgttcctgcattaattcacttgggataatggcctccaactctatccatattgctgcaaaagatgtgattttattctttttcttgactgtgcagtattccatggtgtatatataccacattttctttatccagtccaccactgatgggcacctacgcttattccatgtcttcgccattgtgaataatgctgtgatggccatgcacttgcatgtgtctttttggaagaatgatttgttttcttgaaaaggttttgaatgatgaaaatggacccagtatacctctggaaattcagagcctcctaaaccactccattcatcccacctgccttacaaaaccttcgaagttgctaatagttagaaatcaaaagagaaacttttgctgcttctattttagaattaggaatggaaaagaaagtttgtaagtatcccagggcactggatctcagagtggcagcatgttaatagcccaaaagtcttgtagagaattaataaatgtaataaatattattggtctattgcatatattcttgccattggaaaacaaaaacctgcagccagatccttacaatgtattatttgataatttgaagccaacattcgttgttacctgcctcatgcagctggctgtgtggagaagttttttagctttccagccacattcagctgtcaggggcagtgtgagagccagcagggagttcactgtaagccctgcaaggtttttccaggttagtgccacggagagggagaaacgcgcgagagagattgaaataaattactacggagcctacaccagggatgtacaaagtgaaaaaatgaggcacgtgggggaattatgaaaagaaggagaaggcagtgcagtggcccaggttgggaatacatcattcaaatcttggactcttgttgctagaagggggatgagcagaaagagaagcaggtgatagccggagaactggtggtgaaatggaaatgatggatgggggaaaatgactgtaagaacaatttttaaaaataagttgcagaatcttctctctgttcctttgacaacatcaagccactttctgaggaagagccattgtagacatccctgacttgtttccatctgatgtcttcctatactagaaaaatttgccaactatctgccacctttggccagctgtctagatccaagcagtgatgcatgttttttcctatttcaagtttctttggtggttttggggtagactgaagaacacgtgttctaacaaccattttgcagaagtcataatcgtcatttctgcaataactccagacagacatgatgtttcaaacatgccgggtatgtttgaggactctcaaataaatcattttctataaaaacatacagaattggcttttaaggtgatctttttattcagttgggaaatagctgtctggtcattgagataaatgaatagacaacaggatgcttctttcttcttcactacatgtgttggttctcttggagtggtagtgggtgatcaagtctgaaatccaaaaggcagaaatagaaatacatacagatagatagaaagatagataaaaattaatgatgaatgagattataattctattaattaaaatagtacatctatatattttacataactattttttacatattacaaaataattccataattgcttttatgtattaaaaatatcttgctgcttttttcttatagggtactgtgtggtgtttaaacatatgtatacgtggtggaaggattaaatcaagctaattactgtatctatcaccttatacacttctcatttttgcagtgagaatgtttaaaatgtgctctgttagcaaatttcaagcataaaatacattattattaattatcataatcataccgtgcagtaaatcttaaaacctcatgatagtaaaatacatataacctaaaatttagcattttaaacattttagagtatgcaatacaatggcattaagtacatttccaatactatgcagcccttaccactgtctggattcagagaaatatttttaattaacagaaaaacttataataaaaatttgtagaagttttaataaaattattagagcaataaaataatttaaaagaaataataaaaaagaaaaggttcaataaaaatttgtattcagtagtgatcggatatcaccttcactacctttttgctgttgagatgttttccaacatctcagtggcagcagtggccagttttgaagctggcctctcccagcccctaatttaggagtggggacaaggactcactcctatgggtcatctgtgaccaggggtcatcatgggtggtcaatggcttcgcactatgaacagagtgtgatacaaaatgaggtggcctgactcacagctttatacctgagctgactgatcatgagagcagttcccactattcttatttggggaaccaaaagctatagttggatttaaccaccaatagaaatattaagacatgttgaggtatagaccaatggaacagaacagagccctcagaaataatgccacatatctacaactatctgatctttgacaaacctgacaaaaacaagcaatggggaaaggattccctatttaataaatggtgctgggaaaactggctagccatatatagaaagctgaaactggatcccttccttgcaccttatactaaaattaattcaagatggattaaagatttaaatgttagacctaaagccatgaaaaccctagaagaaaacctaggcaataccattcaggacataggcatgggcaagtacttcatatctaaaacaccaaaagcaatggcaacaaaagccaaaattgacaaatgggatctaatgaaactaaagagctcctgcacagcaaaagaaactaccattggagtgaacaggcaacctacagaatgggagcaaatttttgcaacctactcatctgacaaagggctaatatccagaatctacaatgaactcaaatttacaagaaaaaaacaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaagaaacaacaggtgctggagaggatgtagaggaataggaacacttttacactgttggtgggactgtaaactagttcaaccactgtggaagtcagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacagtgatagaccggattaagaaaatttggtacatatacgccatggaatactatgcagtcataaaaaatgatgagttcatgtcctttgtagggacatggatgaagctggaaaccatcattctcagcaaactatcgcaaggacaaaaaaccaaacaccgcatgttctcactcatagatgggaattgaacaatgagaacacatggacacaggaaggggaacatcacacaccagggcctgttttggggttgggggagtggggagggatagcattaggagatatacctaatgttaaatgacgagttaatgggtgcagcacaccaacatggcacatgtatacatatgtaactaacctgcacaatgtgcacatgtaccctaaaacttaaagtataatttaaaaaaaagaaatattaagacatgttgaaatgcataagtttttaggaccaagatatctgcatgctgaagaacatatcacactccctttgcatcccaagctgcaatttgtcaaaaatgatctttcaagaatagaatggttgctgtgaaacctgctggagggatttcgatgcagtgtttgaagccatacatgcacagatacatgaagaatcacccatggcaaatggccaggaaccctactggcatgcaagaattcccaaatgtctcctgatctacctggaaaggtttatgtaagcaagaagcagaatgagcagtgaaaaagtttatttagaaaataatgttccactcagaaaactaggatactttcagaaaaagagcttccatgcttcagttttcattaacagagatctgtaaatgtgtttctcattcttatattggatactgttctgtgtgtctcattttgtttttgtgtatattaggaagtcatacataacctgaaattagcaaaaaaattaaaaagaagtcatataaatgcttaaaatttgaatagagtgaattaaacatcctctaaattgtaaggttattgattttaagaattaaatgctgattccataaaatttaatatttattatttgaaatttatcaaagctcttcaacataaataatatattttattgtgaactgaaggctactttgcaaatagcaaaatctgtcaccatgaaaattgaaaaactaatgtttttttcccttaaaactctgaaaacagatttacgtaatatgttgtcaattttttttttttcaaatttcaatcttcctcttttcagaagggctgtttgttagaaatatgaatttgaagagcttccagatatccatttatgtttccaaaaaaacacatatcttccaaatatgtatatttggaataaggaacatttttcatatggcaagttttaggaatattatccaaaaaatgcatgaaaaatttgtagattttgattgtaatgttgtttaaaaggtcatatgaaagacacttttacagacaaagctatgaaaagtactatgctaaaattggagaagaaatcagagtttcaagatacgtgttcctttagaaaactagcaaagaggctcaacctttagaaaaaattctcctcttctattcctcattagtcaggagacccatgggcactgcatccacatttaagagttgaataatatttgctgcatatctaaacccttagcaaaaattcgccctcataaggaatcaactcttctaacatttatcttggactttcagccttgaaaactaagagagaatacattcctgttgtttaacttactctgtctgtggtgttttgttactgcagccatagggaactcaaggacaggtgatattaatctgaataaaataccttttatttaacccaatgcatgcaaaatattgttattttaacatgttatcaatataaaataagaatgaggtatttaatgcactttcattgtatgaagagttaaaagtttgttgtgtattttgaacttacagcacatcatggctgagactgcacacgtttcaagtgtgtgagagtcccatgtagctaggggctcccataatggggggcccacctctaatcaatatggacaagaggcagggaaatactaggtagaaaagggtggggtccctagcaagggttccacccttaagtctggacccatggccctaaatgggaacttcacatccctgttttcccacccgaatgttgtcgtttccaaaaccaccctgtcctgccccacccttaaccctgtactcataaaaaccccaagctccactggcaggggaacagaggcgagtgacagagaaggagagcagagaagaagcagccggacatcggagagaagcagcttgacttcagagggacagcttgacggtggaactttggagaggagttcagctggtgatgggcgaactccaggggaagattatcttcctgcttaattacccttccagctccttttcccgttgagagccactttcatcgctcaataaaatcctccatgttcaccaccccccaatttgttcacgcaacctcagtcctcctggaatttggacaagaacccaggtgtgggtgcaagaggctgtcacgctgactctccactgagctatttaacacttaagccatcaacggacagcaaagctaagggagcgcactgcaacacatgctctctggggctccaggggtcacggagaacccctagatgctgccacggggccggtacgggatttgtttgccccagaacctgcacccactcacctgtgtactcccactcctgcaaggggtttgagagctgtaggctgagtaagcgagccaccccttcataagtcccaggaacggatcaagggaactatcttgtctcataatgagggtttgtactcaacacagtttctcccacacaataggcaatccataaagcatgcttgttataacacacaaagcaaaataaacctaccaggcagccgcaggaatcatacacaggggtcatatgagaaaacaaaaaacatgtatttcacttttttcccttttcttgtttttttaaaaaagtgcaccccacttccagcactcatttaattttacataaacattctctttgagactgaagcaaatctgaatgattttcaatgtgaaaataaaatataaaacctgttctcggagttatttctcaagagaagtcacatcagaacagtctgaatcatcagaattgtcatttcagaaaaatcggattcatcaaatgagtctttgtctaacaactgttggagaacgatgttaatatcacatatagtaatgctacattttctaggattcgacattttcagtgattgagaattactgtattttgtaaatggaaaatcactactacaaacagaatgctataaatagaatgatgtcttttgtttccaaagtcgatataacaaggtgatgcaaaaataataacaaaagcgagatatttcatggcaaagttatctcagggcaaacgcagcaaccgccagcaccactggcaagtattttcagggcaactgggaaaaaggttaaggagagaataatctttgaacaatcacaactcaatcacaagaaaagctttccacaagccaacttggcttctccgggaattcttttatagttctttttggtgtgggtgactctccttcaattggtggatttttgtcgccttttgtggggaataccatacaaatacctaccctggctgatgccatctgaggtcaaccttcatgcctacaattttatgccactgttcaaaacatgccaattggaattcaaggaagaatatggtaactggctgactgcagaacctagattcctcttctcaccagttttctttgcaagagttattgtgacccagaggaggttagagaggaagaaattagaggatggtgactatttgcttttaaaatttgatatttgttttgttgcagtttctacagttttagcatccctttggatgaatttttttggtaagtcactaacaaattatataaatgattacaagttaattgatttgatgtcagtttctgtccattgtaaacatccaattggatgtctccaataaatcttgccaatatttcattattgaaagcaccgagcaattgcttttaccttgtgagagaagctacaggcagtatgcaaaaaaaaaaaaaaaaaaaaaaaaaaaagcatgtctgtgttccaataacactttatttaaaaaaaattaaaaacagcaggtttgatttggtgctgttttgaatgattaaaaactaaatgtaattgtaaaaaaattaaaaacacttatgtaaattaaaacacataaaaatcacattacaagtaaatgtttcatgtttccaaaagttgggttttgcttaaatatataaaaaggcaataaaaagcaaaatataaaattgtagtgaataaatattaaattttataaattgaatgatttaagtaatattggagctttcaatttatgttttaaacatgaactttagtctaaaatttaatattttaacattcatttggtagctaaaggaatgatgaccacaatttccatgtaatatccatgtaatatattgaactccatatatacatgtatacctgtgttctatatatgtgaaatacatacaacacatatacatatactcgtacgtattatacacgaatatccacatatgtttatacatgcaatataatttttttatattgcaacttgttgtcagtgaccttgtgcagcttttggagacaccatgctaatttgtaagtacatctagaaccacaatatagaaaatgaagaaagggagtaaacatttactgggcagtgctaggaaattatcttttttttttttttttcttgaaacagagtcttgctcagtcgcccaggctagagtgcagtggtgtgatcttggctcactgcaacctccacctcccaagttcaagtgattctcctgcctcagcctctagagtagctgggattacaggcgtgcaccactatacttggtgaatttttgtacttttggtagagacaaagtttcataatgttggccaggctggtctcgaactcctgacttcaagtgatctgcccgccttggcctcccaaagtgctgagattataggcatgagtcaccacatccggctggaaatgatcctttttattcaaccatcctctgcatctgaggatcctaggtattttctggaaagaggatgatggcttcacagtctaggtggtcaagcctacgatattacgtagatgcttatagaaccatttacgatgcaactacttgtaaagagaaaagtcattcttagccagagcttacactttaggtgtctattctgcattttcactctgagaacaagtgtttgacaaagtaacatttattttatttatttaattaattaattaattaattttttggccattcacctaaacacttctgcgactcagacccttccacataccaaagcagtaaagcaatgtccatctcagaaatgtctaagctataactcacagaccttaggggcattgaaacaagtcacctctggtttcaggaacattcattggtcaaacttgggaaggtttttggaggcataaaaggtgttagtcatgagaacagatgctcagggaggcagttacaccatgtttgagttgagccctggatcccaagtgacaggttcctgttgtccatccttaatctcatatgcatttaattgttgacttctgtttgtgatgcacagtgccttctaaggcataggttccaggctaaggatgttttctgtccaggtgtgggaactgtattgtattatgggatttgggatttagaagaataattaacagtttaaaatattattttaaaaaatgtattgatacataatatttgtacacatttatggggtaaatgtgatattttgttacatgcatagaattgtgtaatgatcaagtcagggtatttagagtatcactattctttaagctttgtaattgggtctgattttcataattactcatttaaaaaaataatatctaaaataaggtagaccttccctcctagaattgctctgaggaataggataagcacattttcccagtctctgaggaatgaaagatgacttcacagggaagatgtgatttagactaaatcctagagattaagattatcaggggtttcaagcaaaggaaatagcacaaatgaagtagtgagaaaagtagaactttaagttctaaaatgacattcaaggaaatatcctgagatggggagaggtatttcttggctaacttgagggcaggaagtcatatgcaattccttacatctactaagcattcagcgaatgcttcctgcaatcaattattcaatcaatcaatcgatcaatcaatcatcagtcaggtaatcaatgattgaatagatgacaggcttcaacttaatctccccggtaaacctgtggtcatatgagcaactcaaggaaggaaataactgcacatgcatattttaggtgcctaattttgttggcatgaattggtatctgggaggagattctgcattaatgaaagctctgaattttagctgtgcttgggagctggagagaaagagcaaattataaagagatttagggaaatctaatatcctaagacttccattacaaagaacaacaaattgggcagtttaaaacaacagaaatgtattgtgtcacaattctggaagccataattccaaaattctagagacaggtgcctttctggatttagcatccagcagtgcaaggtaataaagacggtgaagataaaaacatatcaggaagtaatgttgcttgtgcaggcaacaatgggtacaagccagtagttctttatttaatggtccaagttgccctggacatgcatgaataaaaggaaattaccatgccccgttgggaagcagagatcccttcccttccaattttatgaaaagatgttgccagggtttgttccatctggaggttctgaggaaggactccttcttagcttctctcctagctttggtggtagccagcaatttttggcattcctgccttgaggatgcatcactccaatctctaactcttcatcatacggtgctctgtctgtgcatctctgtcttcacatggcagtctactcactggaacgttagtcatattggatttagaatctaccccactccaatatgacctcatcctaaactaattgcgtctgcaatgaccctattttcaaataaggtcacataatgaagtactaggggttagtacttcaacatattttgggaataagggaggatacaatttgatccttgaaaaggagggtacagctcacatatcttggtatataacatggcatgaaaaatgtgaatttagggaaatcataacaaagtctctaagtgggcatgtagatgaacttgatattaatgaaaacagagatcatcagagaaatcgtatgtgtggcatcaactgggtttataatgcctagaattctttaggaatcattggcaaaagggagttgaacttagaagaatgccaaactctttgtgatccactcaatacagttgtcttatttcttccatcaagtgattattgcactgtgcaagtacacaaagagaaggtggttttgctttatgtataaaaaagtctccaagatttattgatgtatgacaaatgcattgtacataatacattgtacataaagtgcattgtacgtacaaatgcattgtacacaatggattgtacatacaagtgcattctacataaaaatgcattgtgcatcatgcatcatacatatatataatgatacatatggtatatcaatatatatgcaaaataatgatgtaaatgaatttgaatatatacttttgcttttatatttatacaatatcctggggtgggaaaaataggtgttggaaattttgaaaggagaagtggaaggagtactgaatatcattttgagcctcagaacttcatactgttttatggcttccattatgcttaattaacagttggcttgaatatgactatcaaccctgtatgcacttttgttgatatactactgaatcatcaccctgagtctatgtgcatatcatcctacggtgatttgtagaaagatgctgagattgaataattcagtggctgcgtggatggagaacaccttccctatcctgacatatactctttaagcccatgaagctaatttaaagtctaaccttacagcgccataatgtctcaaataaaaggagaggtgacaggtgcattttttggatttagcatccagcagtgcaaagtaatgaaggcggtaaagatgaaaatacattgggaagtaatgttgtttgtgcaggcaacaacaggcgaactgccagtaattctttcctaacttctttatttaatgatccaagttgccctcgacatgcaagagggaaaggagattaccatgccccgttgggaagcagagatcccttgccttccaattttacagtacattggtttacagccaggactgtctgtgtaatactggactttaaacaaaccatttatctctgcagttcttctcttggcactggtccatcgctagacagagtaagttttaccgtgctgccaaggctctgccgtctcgcctccctctggaaggccactttacgttaaatgcagtggaagatgtttgctaaattcccaagcaaatgcacagtgaaaatgtggaggtgaaaccagcaaaataggaccttaaagatgaactctgcatcttcactctcatgagttggggaggatgggagaaatcatttgaattcagtttagtgaattagtgctacatcaaattataattctgtaaagtgcctacattttaaaatactgttatcttcaacaatgtttttccaccatcagagacttatgctcctacagttagggtttctcattgtgcttttaatataaatgtgtacttaaaatatgcagtcttacatagtagaaaaataaggcatattaaagatttataccacatcaataggaggatagccaatttcccccactcgttcattgatatgaaatacagcttcatatgaagtttcagaggtatacacactataaattaaacttcttcaaaatggtgactattactccaatcggaagggaagtgggtgagaggagattgcaaagatgtgaaaaaagtggggtgcatttcaaatacaggttaaaattaacgttatatgcgttcacaagattccactggaatttagagactactccttggctctccaaaacacgaattagataatgccagttctcttggcattcatatcatgatctagtttgtaagtcattattttaaatccatttcgaccatgttttattgctttcattgggtaaatctgaaaattaatccaaagtgcaaactaataaaacaaacactcacgagcccaccattcagaataaacaagcgtgagtagatttatcctcttttcttcacatttgtgtgtgttttatggttgctgtggtcattgttaattcataagactttgtgaacatcattgaagcccccttagttttcagtcctggttttccatttccttcatattcaaagacaactactttgatgagattggtattcattattcccaccattgtctatttataattttaatttaaaaatgtacatcaatttgaacaatgttacaattagctctataagcatttgtttatttaattttttttaagttctaaccacattgataagtattgtaagaggtgattaatggataagattattatgtctggccgagtagcattgctcatatctgtagtcccagtactttgggaggccaaggcgggagaattgcttgagctcgggagtttgagaccagctagggcagcataacaagaccctgtctctacaaaaagtcaaaaaaattatccaggcatggtggcacaagcctgttgtcccagctacttgagaggctgaggtgggaggaccacttgagtccaggaggttggggctgcagtgagccataattgcaccattgtactccaggctgggcaacacagtgagactctgcttcaaaaaaaagttaaagatccccccaaaaataatttttaaaatattaataaattaaaaattaaaaagattattatatctaagtctatttgttcttaaatgactggatattatttaaataggtggagcattaaaaaagatgctgataatagggtggtgttaagggctgaattgtgtcactccccaaaagacatgttgatgtcccaacctctggtactgctgaatgtgagtttatttggaaatagagtctttgtagatggggtcaaactaagactaggtcactaggatgcaccctaatccacatgacttgtaaaagagggtttttgagacagagacacatatgcacataaagagggggttatatgaagagacacagggagaacgctatataaagactgtgcaacagggccacaagccaaggaacatctagggctaccagaatctagaaaggcaaagaaaaaggcaaagaaaaatctttccctagaggctcagtggaaagcgtggttctggtaacaccttgattttgtgcttctggtcttcagaaccatgaaaaaataaatttgtgttgttctaaatcacccagtttggaccaggcacagtggctcatggctgcagtttcagtactttgggaggctgaggtggcaggatcgcttgagcccaggagttcaagaccagcctgggcaacacagaaaacccaatctctacaaaacgttaaaaaattggccaggcatgatggtatgtacctgtagtcccagctacttgggaggctgaagcaggagaatagctgaagcttgggaggtcaaggctgcagtgagccatgatcgcaccactgcactttagcctgtgtaacaaggcaagatcctgtctctaaaataaccaaacaaataaacctaaaaacctcactcagtttgtggtagtttgctgtagcagccctagcaactaatacaggtggtctacatgtcttcttgtgcatcaggtaggaacacttctaaggggggaagctagcagtccaacttctgagccagagtgtgtaactcattgtttttcaattttactaaataattgtatatatctctccctactggttgtagcaatgtttattaaaaaaaaaaaaaaaaaggatgagaatcactattctcttgtaatcttacacgtcatagagttagactttacattttttattcctttatgtatttttaattgacaaataacgatagtatatatttatgagaactttgtgtgttttgttttgttttgtttttttgagacaggatcttgctctgtcccctaggttggagtgcagtgacatgttcatagcttgctgcagctttgacctccagggctcaagagatcctcccacctcagcctcgtgagtagctgggactacaggcacacaccaccacacctggttaattttgtttattttttgtagagatggggtcttgttatgctgcccagactcgtctcaaacttctgagctcaagtaatcctgccacctcagcctcccaacaggcatgagctatcatcccagcctgagacatttaaaatcgattatcttagcaattttccagtagacaatacattgttgttaactatagtcaccatgactacaataggtctcttgaaattattcctcccatttaactaaacttttgtatcttttgaccaaccactattctactctctgcttctatgagttcaactgttgtagatttcacatataagtgagatcatgcagtatttatctctctgtgcctgtcttatttcacttagcataacatcctccaggttcatccatgttgtagtgaatgacagaatttcattttttaaggctgaatagtattccattgtgtgtaggtatcactttttcttttccaaagatgcttaggttgattccctgtcttatctgttgtatgcagtgctgtgatgcatatgggagtgctgatttaattttctttggctgtatagtgagtagtgagattgctggatcatatggtaattctctttttatagactttacattttgttaattacatgtgtataagtaaatgttattttctatcattagagagatgcataacatctttccatatgtttactggatgtttcaatgtcattgtaagtaatgtgcttattctcctttatgttctattatcattttgtctaatgttttaaattgacttttaagaactatttacatataattggttttattctttcgccatttatatcccttgcaaatttatttgcacatttcttgttttccagatgtgtttaggtagtctttgaccacaagatttttttatttttttgagatggagtctcattctgttgcccaggctggagtgcagtggtgccatctcggctctctgcaacctctgcctgtccaattcaactgattcttgtgcctctgcctcccaagtagctgggattacagacatatgtcaacacacctggctaatttttgtatttttagtagagatggggtttcaccatgttggccaggctggcctcgaactcctgacctcagatgatccacccgcctaggcctcccaaagtactcgaattacaggtgtgagccaccgtgctggcttgaccacaagattttatttcaaaatccattttatcattctttcatttaatatttgcacttttttcatcttctattataaaaattattcaattcataaattaatttttttgaagttttagttagttaatgtatatttaatttattgtgagtagctattttgttttcttttccatatgataaccaattgcctcacatttgtggaaattgcaaaatttcatcttttatttataataccatgtgtctatatttatgacacatatgtctttcaatgacaatctgtgcatacatctcattctatgctctcaaatttttaattttctttatattcttaaaacagtttgcactgtattaatttgctagagcttcataataagtctatttatgattacgtagtcaagtcccatgaaaaatgtgcatggtgaattctgtttccaaagatgtcccattctcccacctcataaattctttagcaatgttgtcttgacattaaatactgcagttctttcttgaaactgggctgaccctaggctctgctttgatcagtaaaatgtggtgaaagtgaaactatgtcatttcctaagatgggattccagacatctgcagacctcacctttgctgctgtgaacactctttggaactcaaccaccatgctgtaaggaagctcaagccatcatgaggagagattcacatggagaagaaccatagactctggccagcagcctcagctttgctctccactaacaatctctcagctggacacatgagtgaaaccttattaaaccttgtaccccagacaagccatcatttgaagcagctaaataaatgccccaatgtaaccacccaacaggctcaccttgccctcttgctagacagagccaatttatcaagacagaggaattgcaatggagaaagagtaattcattcagagctggttgtgtgggagactggagttttattgttactcaaattggtctatgtgagcattcagggattggagtttttagggataatttggtgggtaggggctcaggaagtggggagtgctgattggttgggttggagatataatcaaagtgggtcaaagtgaggttttcttgctgtcttgttcctgggtgggatcgcagaactggttgagccacattactggtctgggtggtgtaagctggtgcatccagtgcagggcctgcaaaatacctgaagcatgaatcttagattttacaatagtgatgtcatgcccaggagcaatttggggaggttcagactctggcagccagagactgcctggcccctaaacagtaatttctaattttgtagctaatttgtaagtactgcaaaggcagattggttcccaggcaagaaaggttttttgtgggggaggggcggggaagagctgttatcaattttgtgtcagagttaaattatgaactaaattctttctcaaagttagttctgtctatgcccagaaataatcaaggacaggttaaacgttagaagcaagatggagtcagttaggtctgatctctttcactgtcataatttcctcagttacaatttttgcaaaggcagttcagcaaccatcaccatgaatagtagaagaacctcttcccccattctagctaatctcaaacccctgatctatataaatttatgaacaaatagtgtggttgtcttcagtcactaacttttgggctcatgtattatacaactattgataactgaaactattctatttgattttttttttttatagtctcactcttttgcccaggctggagtgcagtggcatgatctcggttcactgcaacctctgcctgcaaagttcaagcaattctcctgcctcagcctccagagcatctgggattacaggcacccacaaccacacctggctaatttttgtatttttagtagagacgaggtttc[132 bp omitted]tcacaaatagatgtaagatcaagagagatttgcctctaaaatattgactatctccatctgtgcttatgataccagtttccaaaaaggaaaattagttttctgtgccttgtcttggtttacagacttatttactcatcagcaaacttcatggacccttttattattctaatgataaaattctttattctaattccttgtacattattttgtattattatccagctatccctgttatatataatgacaacattttctttacctttataagcaaataacccttcatatttcttcttacattttgaatgttttgaaggactcctgaagatccaaggatccagcacaaatgaaacttattgaacaaaaagatgcataggataccagtttcaatagagaaccgagagtaaggcttggggtgatgctgaaaatcacgcgtggtcaaacttcttatgggtctatcattcccacgcctgctgcttaaagaaaatgcattgtactttaaaccagcaataagtttatggattaattaatccaattagaacatttttctttgcctagcatacagtttttgcaattttccctattacattcaatcaaataagtaataactaagtgcatctgtagtctggaaaagaaaatggaacagaaagagaaggggtaaaggtaaaaattccaacagtccctttccccacaagaataaccccatgcctgatacttgtcttaggaacttgaagaatctctctgagtcctgctacatcagcacttttgggattaatccatgggtgtttgaaaggaatgcattgtaagtttggggaaatgtttcagattatctttgttaattgtgtctttgaaatcctgcatatttcaaatatgttcaaattaacttgaattaccagtttctgagaaaagatgatgaatgtctccaactacaaaaggactttgacaatttgctctttaatttctacattgactgctacatggctattgaagtttcttaaagaatcatactacatataattataaaataatcctcttttctcagttacgttttcatcctgggttttatattaatttaatagttacacttgtttttttatttgccactatttacctggcattatgtttctattgctttactttcaactttttatttgttatttatgttttaagtatttttaaattaaatcatatagctggattgtgcttgtcttatccaacataagaatgttttaattttaatggggtatcttctttaatatgcatttgttaatgtatccatttgatctcatgctttctcttatatactaagtggcatatgagagtttattttgtcattcctgttattatttttccatcctttatttttgctgaactgtgtgagtgaagtggtctctttgtgccagattgccatatgcaaagtcatttacatttacatctgttgtagacctaacatcaataaagacgtggatattttcttttaaaatatcgttagggcttaggtcaatattaggagtaaattatcatgtattctttaactaatggacttattggaatatgccagaatccactaacacctaaaaaagggtagcacactgaagtattgataattaagactcagagtcaaatttctaagtaattttccatttctgtcagtattcattagaattaaattttaatatgtgcataagccttaatctaattagaacatccagaaaaaaatgtttctccagtcagtcatgggaagaaaaagattggcatcattacccaaaagacagcaaactatgaaatctaagagattgtttacactaaacttattttcacatttcctggcactgcataattcaaacccactctgtgcttactgggatactttcatctctaacatgaagaggaaaaatataactttttaaaagcaaatcttcaggttggaaggttaggtgtttgcctgaaaagccattcatttttgcttcagcaaagcaatttgcagtagagaatgatttccatctcagctagaagattggaaaatgaaactgtaagtgggagtgttttactgggcattctagccttggaccctggtcatggcggggaatgtgatgatattttagcagcttttgtaatcctacactgattttcagaggatatgtttgggttttctgccatttaactctctggttggaatctgaatcgggatgaatctttagtcaaatttaaattttggctcatgaatggagggcagacatttttgtaatggttcccaaattacgcaaaactcttcaaatataaatggtaattggctgatttcaatctgaaaggagttggtattcacaggcaaccattcccgactttcttggggtgtcagtagaatacaaacattagccaagcagtggcctcaaaggcctgtgtatttctacagtcacagtgaattcaatgaaattgaattctgcaagttctttcttaaaagtgtccattagcataggtgtaaatagaataactactttcccttggaggtgaaagtaatttgctgtaggaaaaaaatattttctctaacttcaattagaaatctcttctctctctttgattaaaactatctgccttactaattaataatttgaaagatgttgagaagcattgagctttgagtaacaataaaagagcactctagtattgaaagaagatagctttcagagtttgaaggagcaacattctttgaacttgcatacatatacctaggaaaattaaaaatgaccatctgtgcaaatggttataaactcagctggcagtggaatcctggcacaggggtgtgaagaatttactctgaatctctgggctctttttcctttgctaactcacttacatctctaagattcaactttttttttttttttttttttttttttttttttgcgacaggttgtcactctgtcgaccaggctggtgtccagcagcatgatctcagctcactgcaatctccatctcccgggttcaagctattctcctgcctcagcctcctgagtaactgggattacaggcaccaccaccacgcctggctaatttttgtagttttagcagagacggggtttcaccatgttggccaggctggtcttgaactcctgacctcaagtgatccacccacctcggcctgccaaagtgctgggattacaggcttgagtcacagtgcctggactcaactttctttctttaaattttattttatgttctgaggtatatgtgcaggatgtgcaggtttactacataggcacacatttacctaggttcaactttctcagttgtaaaaagcaaataaattataggagagtgtttatgcactttagatagttactgaattattcactattttgaatgttgttctaaatttgtagaggaactagatttggattagtaaaagttactggtgagaatttttactcaagagtagcattttggaaactcattgtccaacaagactgaagtgaaggttcaagtgcagcaacagcagagaggtaatgaaaccacttttgcaaaattcatgacagtaagagaattatgactgtgaaagagatctgacctaactccatgttgcctttaatctccaaactgcccttggtcattcctgggcatgggccaagctaactttgagagaactttagtttatggtttaaatgataatagcccttcccaaaattaaactgcctttgtaaaactaatgaaaggcaaccaggttaggagaatgagaggtgcctgaagtctgctaatatataggtgatatggtttggctgtgtccccacccaaatctcattttgaattgtagctcccataattcccacgtgtcatgggagggacctggtgggaggtaattgaatcatggtggcagatttttcccatggtattgtcatgacagtaaataagtctcacaggtctgatggttttataaaggggagttcccctgcacatactctctctctcttgcctgcagccatgtaaaatgcacctttgcttctcctttgccttctgccatgattgtgaggcctccccagccatgtggaactgtgagtccattaaacctctttcctttataaattacccagtctcaggtatgtctttattagtagcatgaaaacagactaatacaatagatggagttaaaacattaccagccattattatgaaggtcacaagatttgcaaattccccaaatactcctgtaaataacattgccaggccagctgtcagagccccagcatcaggaattggtcaacttgcaggttggtaagaagaatttaccgacaacagtataggtttgaaaaggaaagttctattagatagagagaacactgtagcagagtgcaggggaggggcaccttagtgagagaggactgagagtgctgctgcagttcataaggtatttatgaaccttaaagggggagctgaagggtaattttcatgataaatgattacatttgtagacatgttggtgccttaatgtgggcaaaggttgcacaataagttttgatatgcatgcatttagagacgtatagaaattctagtaacttataaaagttgaaagaggcctggaaccagatgctgactttagataccagggaagtttaattacttctaaatcatctagatgagttttgcctctggatggcctgtttgatggtcaccaagtggtgtttgctcccttctaaattcctcagagagggagtttttgtctccaggaccagttcaatggaccccaggtgatttttgctctcctaaaacatcactattgtgtaacctaagattggccttttgcgaagtcttttcagacttttgcatttgtgatgaccagatggctccatccagactcaagattcatgactcagtggtcctgtggccccacccagaaggggactcagcacacaaggaccgttttccacacccctctgattttatccacaaccaatcagcagcatccattctctagcccgctggctgccaaactatctccaaatttttgatgaggttgattcgaataataataaaactctggtctcccatttagctggctatatgtgaattaaactttctctattgcaattcccctgtcttgataaatcagctctatctgggcagcaggaaaaatgaacccatagggtagttataggaaggtagcaggaacctccagattaagacctgatgccagggctacatcaccatgacatcaggcatgaaaaaaaagcagtcagtctcttttgaccctgaataatttgccagggccaaatggacttgagtcaactggcagtgcataggactatggattctgcaaaatggatatggcttagagagaaatgggatggctatgcactgatcagcaattcctagataagtttgcaatcatagtagattcattgtgcaatgcacacagctagtcaatatggagggacactggattgcagcacagaacgacagcctccaaacaaacagacaacagaaagcctcaaattcatctctctgtggaatttggtgctagggattttaagggttttagagtgggctgaagtgtggagatggttgattggtgggagactgcagcatagagtcatgggacagagagaggaagaagctgtgttctcatgctgatcccgttcctctgtgggcatcttcaaatggttgctgaaattcagggcctggaaaacactttaagcaattcttaaacaacagccttatgattctaatgtcagagattctgtctataggagcaatgaagatgtaaatcaattcttaaacagtcttatgatgctaatatcggaaatcctatctataggagctttgtggatgcagatggtaagtgtctagtgctgcagggcttttagcaacaaggaagtgggccaaagtgcagcctgattcatgcttaattataagtgtatttatgtccagaacctgggatgcaattcttgttaaccctgtggggatggtttctgcagtgcagaggaccatgtatcctgtaacatggatacagattagagaaaaatgggatgactatgcaatgatcagagattccctgatacatttagaaattgttgcatcataagctgggagcaagctagccatgatgaatgaacagcccccaaacacagtatcagtgtctgtttcattgctcctgcaaagttccacatttagattgcacttatggccttgaccccaggaggaacaacaggtaaataatgcacctggatagccccagagtgacatcccctgcatcggtgtcagctcattctaagggcagtttctgaccttgaggctaccctgcatcctagcagttggcttgctctgtaagcctgtttttgaaactgccttttgcaagatatatgacagtgagagaaatctaacatagctgactacgtcttgcttttaaccttacaagtgaactaactttgttaactttaaagaagattacaataatcccttccaaaactaaccccttccttgcttaggaacagaagactaatggaaggccacaaggttagaattatggggacggggtacctgaattcagctaagatgtaggtatatttaaatgataaccagccattgctccctagtttgcctttctgtaatctcttactgcccaagagtcatttagctggaggtcaaaagatttttaacttccccaattgcttctatagatagcatcattattgtgaaaacctaagatttgtctttgagatatttttcagacttttgcactgtggctaaactagtgacctgacatcagccaaacctacccaggcccatgattcatgactcatcactcaactagtcttgtggtcctcacccggaggtggaatcggcagacaagaaccgttttccacactcctgtgatttcatccccaaccaatcagcagcaccttttccctagccctttgcccaccaaattatccttaacctttttccagtttagaaaaaaatagtacagctttctgccaccactcatttaattttacacaaacatgctctttgaggctgaagcaaatctgactgattttcaatgtgaaaataaaatataaaagctgttcttggagttatttctaaagagaaataacatcaaagttgtctgaattatcaaaattgtctatttttaaaaaattggattcatcagattaaactccagccaataactgttggagaacaatgttaacatcacacataggaatgctatgtcttctaggatttgacgttttcagcgatcaagaattactatatttagtaaatggaaataccattactacaaacgaatgctaaaaatagaatgatgtcttttgtttccaaagttgatacactagagcaatgcaaaaaaaaaaaaaataataaaagcaagatacttcatagcaaagttatctcagggtaaatgctgcaagcaccgccagtgagtattctcagcgcaaacaggaaaaggttaaaaaccctagtttctgagctctcagggaggcagatttgagaaatgtgtcccatccttccactgggcttccttgcaataattaaactctctctactacaacaccactgtttcagcgaattggctttatctgtgcagcagacaagaagaacccactgggtagttacactttcttacagaatccttctcagcctgtgagtgagagcctggcatatgtctcgcgcttttgcaagaatggtgtcctgctttttgacttctaatccagccattggctgttccttctcctgagattatatgtgactcaaatcctttctgcatatcattcgccttctggaatccctggctactgaccccagctcactgtttaagcttctagacactggcgcttcccttacctggtgtgagcttgggacacctggttggacaagctagaaatgacagctagctggtttattccagcctgcgttctgtatcatagtggggcttcttcttgctttcgttttttttctctctttttgctggtgttcctgttggtctgagcatataactactactactgtaaaagaagagctatactaaaggggaagcactgaaccctagagagatcaacgcaccgagatgactttcacatcacctgcaacatacatcttatttattggctccaatagtagccttcttactaccttacagactcaaagtggaagtaagatgatggaagtaagacatcaaagtggctcctttgatgccaaaagagttctgttcctggactgagttcagatggcgagtttaagctccctctatgaaggtcatataacttgtgttagaataactaacttgtgtccatcccatacactgattaaaattttcaatatgtttaatgagggagagctaccagtgtacctgcgaaacatgcgttttgtcatgtgtttgtcctttttctgagacagccaacaattgtgatggctttcagttatattttgggggagctcagccaatcactgggggctacacataattcagacatagaatgcatatgtttgtgagactcttatttgatctcattggatgccctcatttcctgtcgtaactcaactgattctactccagggaggtccaatttgaatattgagaacatatttcagggaaaaaaaaaaggacaatgttgctaccagatcattggccaatgtatgctgccatacaaagagaagggtttaaaaaattatttattcatttatttttggaagagactcttgctctgttgccaaggctggaatacactggtgcgatcccagttcactgcagctttgacctcccaagctcaagtgatcctaccacctcagcctcctcattagctgacactgcaggccaccacacccagctaattttttcttttatttatagtggagatgggggtctcactatgttgcctagggtggtcttgaactcctgggctcaagcgatcctccttcctcagcctctcaaagtgttggaattacagaggtgagccattgcacccagtcagagatggttgtttataaatataaaggaagaagcattcctgagagaatgcttaatgaagacttgctttttgactatctttctgtggatggtcaaatctatataagcaatgtggtgtacatctgaaggtgtcttattatgcatattattgattctagaaaaagtatcaattttgtttatttcaataggtttttggggactaggtggtgattggttacatgaatgagttatttagtggtgatttctgagattttggtgtacccatcacccaagcagtgtacactctactcaatgtgcagtcttttatccctcacccccctcccacccattcacccaagtccccaaagtccattgtatcattcttatgcctttgcatcctcataacttagctctcacttatgagtgagaacatatgatgtttgagtttcctttcctgagttacttcatttagaataatggcctccagttccatccagattgctgcaaatgctattatttcattccttttttatcactgagtagtattccatggtgcgtatgtgtgtgtatttatttccctctctgtctatatgtgtgtgtgtgtgtgtgtgtgtgtgtgtgtgtgtgtgtatatctcacaatttctttatccacttgttgattgatgagcatgttccatatttttgcagttgtgaattgtgctgtataaacatgggtaaggatctgaaaaattttctgttgtgagaagagatgtaaatattcttaggcaataataaattgatttaaaatatcaggggataaatttcttattcctttttataaataaagggataagaaaaatagcaaataaagactctatccatgttattcaaatggcctcaccaatctcaacttatcttttaaattagatttttaaaaatttccagtgttccaaaaatgtttattttaattgatataaattgcacacatactattcaataacctgctttgttaattcattgtggtagaaaaaaatcacaacacaaaatttaccatcttaaccatgtttttaagtatatagttcagtagtgttcagtaaatttacactgctgttcaaaagatctccagaacttttcatcttgcagaactgaaactctgtatccaataaacacaactgctctgggtcctcttaccacatcacctagtaaataccattctgttttctgtatctatgactactatttttttctttctatacacatatgattttaagatactttcatattgctatggggatttttcatgctttgcaacttctctcagtttcttcacacatgaggtaaagccgatattagctacttaatgtactgttgctacaaaattatggtctgggccacattaaataatatacgtgaaagtactttggatactggggagttaccgagacatataactagacattaattctatagagaaaatgaaatatgttttgcctgtcccaaatgtgtcaaattgattagaaattgcaaaaaattagttagtagagccttgggaatttattaattgattcttacttatggtatttatacttctgtttgccccatactgatgtcattaaatgactacatgcagattttctgttgcataaatgtactcttgattcttcagagtttctgacactgtaaaacaagtacatatactttgttttacaaaaagatatatatatatatatatatatatatatatatatatatatatacacacacacacacaggcatttctcttttgttgctggggatatacatacacacatatacatatgtgtgtgtgtatgtatatcatcagcaacaaaagagaaatgtctttttaatatggttgcaaatgctgctatgtttaaaaatatttaaatattttcaggttgaaaaatagagttgaaatctttggcagaataatcaccatattctctcacactgtaaaatcggttaatgatacagttccaaatgctgcctgtatcatgaatccattcctctgtgtctgccttcagctattttaatcatcctaacatgaaataacttgtaaaaagatgcagtcccattcctgtcaccttgctttgaatgcttctgtaatggttttctaaattatttttctaaccagttttgtgctaaaatctgctacagagatgaggccttggagcagggatgctggccacccatggagaaaaatgagacctgtgttccaggctgtcagcagagtcccggaggctttgcccatggctgtggttcaaactgtgttccacaaatacttgcaactgtctgcagggcctcggagacatgggccaaatgggtttccctcccaaatacccaggcatgacacaacttcagctttcatctaattatacactggacatccacaccgtttcacctgcaaagggttctactgttaaaataaataaacaaaataaaccctctcttttataatatgtgaactttaaattaaaataaaaaaacagattagcaacgcaaagtgtcccttgcactttttgcagccattgatacattgcatacacatcaattcaaggtaccttgtattatcacccttggagagggtgaaaatccccgactacggtagtctcaatttattctgccaacaaatatggattgatgaatttcttctgttgtgggtattagaaatggagcagcaggtaaccgcacaggggcccctacccttatgttccccaattacctcatttctctgttacagtccaagtaagattttaattcctttcccttaaaatcaaaacctcttcctagtatttgtgatacatcacaagcaaattatttattaagagtcgctgtcatttttttttttttttttgagatggagtctcattctgttgcccaggctggagtgcagtggtgcgatcttggctcactgcaatctccacctcccgggttcaagcaattctcctgcctcagcttcctaagtagctgggattacaggcgtgcgccaacacgcctggctcatttttgtatttttagtagagacagggtttcaacatattggtcaggctggtctcgaactcctgacctcaagtgatccacccacctcggcctgccaaagtgctgggattacaggcttgagccaccatgcccggcctgagttgctttcatttcttattctgtcttttacaaaatttatacaaaaaacttgtcttttgatactcctaatttaaaaagagagaaggccagccttgtaagcccaacactttgggaagccaaggtgggagggtcacttgagcccaggagtttgagactagcctgggcaacatggtgaaaccccgtctgtacaaaaaataaaaacaaaaatattagccagccatggtggtgcacacctgtagtcccagctgcttgggaggctgaggtaggaaaattgcttgagcccgggaggcacaggttgcagtgaactgtgatcacgtcactgcactccagcctgcatgacagagcgagaccctgtctcaaaaaaaaaaaaaaaaaaaaaaagaaagagagagagagaagaatgaaataaccagataggaccagtaaatgcctgaggccaggcatttttaaaagtatgtatctatgtctgcagtgcctagtgcaatgtctggcatatttaagatgtgtaacagagatgcttcttcacttacaatggagttacatcccaacaaactcatcataagttgaaaatattgtaagtcaaaaatgtcgtaagttaaaaatgcattgaatacagctaacctactgtatctggcctactttaaatgtgctgagaagactcagattaccctatagtttgggaaaatcacctaacacaaagcctattttacagtaaagtgttgcatatctcatgtaatttattgcatattacactgtaagtgaaaaaacactgtgttggtattcaaactatggtttctactaaatgcatattgcatttccatcatcataaagtctaaaaatgtatgtcaaactatcataaactgatgactgtctgtatctgcatatgaatgataaatatttatacaactaagtggtatgtgaattggaagacattccaaaattttatacatttacaaaaaagtatataatattacagcagatctatccaacctgtttcaacagaatatctgttctttttgagatgaaaaatcaaatattttggaacaggtcactaaaatgcattagaggatatccttttgccatgggctgtccaacgtgagtttctcatttgttgtatcacttctctcctgatcatcatggatactatactttttttttgtatttgagaaattttaattattagagagatttttcatacaacatttattctgtaagcaaatttcaaggagtgcagaatgaatcaaattaatgaagctgattagaacttcctctgaaggtatcattgtaaacattaatttctgaatcagtgttgtaagtattttggaacatagacaccagatcacattttaactgtacttttatctctattaaaaaaatgacaaaaaaaatcccattttgtgcatgtagcattttcaattcccaccatcaatgcatgatagttcttggttttccacattcatattgttatttatccttatgagaattgtgtgctttaaccattctagtaggtgagtaatggtatctaattgttatttaaatgcacatgtccctaatataaatttcatatttaacaatttttatataatttttggtgatatgcctttcctgatatttggttcatttttaactgcattgttttgttttgattagttgtaagtttacttgcatattgtttataaaagtcatttaacgaattaaaagaattcttttaacaaatttgtgacttggaagcattttctccaagtctgtggttgtcttttactcccctatcagtgtgtactgcagaaaaatatctgcctgtgtgtgtgtgtgtgtttgtacaaattttgatttaaaaacatgtaaaattttcttcatccatagatcatgtctttggcgttatatctgaattctcattataaaatacactaatagtgattatttttctccaagtctctaatctcaggccacaatcaactcatgagtgtttaaacttcacctactggattgtaggactatccacctgagatatttggaatacttctgtaagaagatgtgttcttcccattatttctttatttcattatctgttaatgttcatattggtttatggatgtctatttcattccctgaagaagatccatgctactttattcattttattggtcaaatcactacagctttattcggtgccgggagctcatttattttggatcctgcattcttgcagcacaccccatccttttatcttggaacacttccctgtttcctgatattacaataaattctaagctcattttcttttcttttttttttctattatactttaagttctagggtacatgtgcacaacgtgcaagtttgttacatagatatacatgtgccatgttggtttgctgcacccatcaacttgtcatttacattaggtatttctcctaatgctatccctcccccagccccccaacccctgacaggccgcggtgtgtgatgttctccgccctgtgtccaagtgatctcatcattcaattcccacctatgagtgagaacatgtggtgtttggtttcctgtccttgtgatagtttgctgagaatgatggtttccagcttcacccatgtccctgcaaaggacattaactcatccatttttatggctgcatagtattccatggtgtatatgtgccacattttcttaatccagtctatcattgatggacatttgggttggttccaagatactgtccattttattagcctttttgtaaagatgtatccactaatgcataagttaccttaagtcacaaagaataacctgaagtggatgacttaatccttgatcattctcctctggaatgagcatttgatcatgggttttcacaggcacctctgcctcttttaaaaccacattatattttagagctatctcctccctgactgttgccttactgccaaggactcaggatttcaatctaagttactacaaagtcagcagggacttctgattgatcagtaaatatttatacacaactccatcctaggaaacaattacacatccttgagcttaatcaggtcatcattcttccaagttatggttttagacttttctctaaactccaaaaataaaagtaaaaatgatatttaattagacattgtattagtctgttgtcatgctgccaataaagacatacccaagaatgggtaatttataaatgaaaatgatttaattcacacagttccacatggctggggaggcctcacaatcatggcagaagaccgagggatgtcttacctggtggcagggaagagagagcttgtgcaggtgaactctcctttataaaaccatcagatcctgtgagacttactatcatgagaacagcacaggaaagacaccccctgccccgccctcacccatgattcaattacctcccaccgggtcccgcccatgacatgtgggaattatgggagctacaattgacatctaaacattcaatgttacaggtaaaagccattcaattcttttaaccaatagccaataacctctgttcaattcttttaagcaataaccttgaatgtttattttcttattttatactcaaaaatacatgtactacaataatccaaacacatttaccaacatgggatgataccatagctgaattgacaagcaacagagacgtctcataatcaccctaaaattgctattggaacttggctcccagccacatttattttgtctttagagaaaagctcaataaaacagaggctgcaaactgaaccctaaaatagcactggcctctcaggccaggactttccccaatcaacaacattatgcaaaggatgttccagattgcagcagcacatccaaaattaaatgtcaacttgtctgtgaaaatggctcaggcctctcgacctaatgcaatgcatgtaaaatgagtggcctctgcactcagagcccctcaaccaaagggctgtccatcaaagtcactcttcaaattgcatttgaggaagaagcaacagcagagcatgcagagattgtcaagtgccacacactgcctgtctgtatctctcttcttcagaaacggccagagcccagtgggaactggaacactgagccctgcaagcattctctgtgagagagaagccccaatctcaaaaaccaacaagaagcagaaaaagcacaatttccacttaagtggccaaatgcacagacaagtccaagggttgtacgcaccacgaaagtaaaaatggcccatgtgcttgcgttagtcttgctgtattgagcatcccttcattgaaagaggcagattttacaccattctcccatctgtattttgttttcttgcacataaatttcgctgctttttatctatttaccagactctgaaacttccatctttgtagttagcgcttcctccatttttattctctgataactcatactcattctgcaagattcacttacatgtatgaccttctcaggtaagccttttataaaattctctcccctagaggcagtaaaatggccttcccaaatcatgattttgtagcttgctattttatttgcattatagactttacaactgtatgatcattgggttgtggcttatgtcctgacagctacacaataggttactatgtgccttcatcttttcattcatgttttatctcttggtacttttgtttcatgggatggttttgtaaaatgggacctgagaacacttctacttggagattttcctgggttaaatggtgtccctctgaaagtttatatgttgaagtcctaagcctagtccttcagaatgtgaccacatttggaaatagggtgattgtagatgaaattagttaagatgaagtcatataggagtagagtgggtcactatatcccaatatgactggcattcttataaaagagagaaatttagtcacagacatgcacataagaatatcatgtgaagatgaaggcagagatcagaatgatgcatttacaagtcaacagacacaaaagacttgcagccaactaccaaaatctaagggagtggcatggaatagatgtgtctctaatagccttgagaaagaatcaaccctgcagacaccttgacctcagatttctccagaacagtgagggaagaaatttcaattgaccatgccacctagtttgtaatttgtagtactttgtttcagcagccccagggagctaatacggagacttacagttatattggaaaattgaagtcaaggggaatgtccatgtcatactccttatctttgaaagaaaatcactacattctttcttctttcttcttgtgattttgctggtttaatatcagaagggcaaacagttccttagggtctaaaatcaggaagctaagcacaggtctccagtctatctctggttctgaagcatgagaaacttcttctaaccaagtaggagatgacaggaggttaaacggccatgccaagtcatgacttgggatgaatcactgaaaaggaagaacatctgatgtggtttcccagactggtgattcaagaaacatacgagattccacccacaactccctttaaaagaggtcacacaatttttttcagaatattcagcttttaatgctttatctaagaacaaatccattgacaacagaccctgaactatatggtgttagacttgaagaaaacctttttctcacctcattttcaagattcaagaagtagcaataaaagaacgaagaaagttaaatcaaatgggattatcattgaagagcaaaatcccggcttttgaaatataatctcagaagatttaatgaagatctgagtggctgttgttggatcattcaatatggtaggaaggaaataccaaaaaagatgtttaacttaacttttaacattttgggttttttttttgacagagttttgctctgttgcccaggctaaactcccaggctcaagcagtcctcccacctcagccttctgagcagctgcaaccacaggtgtgcaccactatgcgccaggtaattttttattttttttgcagacatggagtcttgctatgttgcccaggctggtcttgaactcctgggttcaagaaattcttccacttcagcctcctaatgtgctgggattacaggagcatgccactgcacccagcctaaaactttattaatcatggtctcaacaaacatccatgcgttgactttagagatcagagcaaacatcaatttaggaattcgaatgttgaagatcctcaaatccatggactgactggctgtctgagttaacccagggacacccactctgggcatgtccaccataggctcactcatcccacaagggctaagacaacctcattgtatcctgtagcattgctctgtgttgtggttctccatgagatgcagagacaggcacatcccagtttcactaggagtatctctttcttccaaagtccaactaaccacggaaacatccctttctctcgcagcagctatgggtctttccaaacttcagatctgtccccgaactttctcagtaaaccaagagcttccatgggtgcaggtcttgggcatcttcatcttggagtcatgagcttctaatctgatccttatacaactggttgcttcagaacatgtgacacggcagcataattctttgttattgtagtaaaatccacacaacataaaattcactctttaaagtctgcaactcagtgggatttagtacatttacaaaggcatgcaaccatcacctgtatctaatgcaagaatattttcatcactccaaaaggagacctggaacccatgaaacagtcactcatttcccctctccagctcttagcaattgctaacctactctctgtctctatggatttgcctattctggctattttacatagataaaatcttgggtgtgtgttttgatataattctgaagcaccaagaaaataaagccatcatgcctaggactgcattccacagtgaaatcgatggatgatacagtttctactattgcagatagaaataaaagaaatgccatgagataaatgaaaattgcctatgttttgagatttgtattcattaattgatcatacatcatccctcaactgtccatttatatctttgtcagtctaaataatccaaatactatcattgtctgtacggtctgtcaattattaatctcccagtgtcagggtaggaaaactgacatatccgattcctcctttacttttcaattctcactttgctagatgcttgtgtcatttctttttcctgtagacctgtaattctctcacagattgacatctgcttcctttggtttgctttaaacataaatactgaaaaaaggacgtcatctctaaagaaagtaatttgtttgaagggaagttgtattacatcttgtcacaccagtaccgttctgttgctcactgacctgatcctctgggtgtctcttaagttctgcttggacttgacaggtttgaaaagagggaagaaactgcactggtgatgttgaaaatacaaaccacatgaagtaaagattatttaaattgacaacaactacgatgacactattttgcaaatgtaatcctttctttagaaacagatagtctagaatgtgatactttatgtgcagggggagaaaaaaccaataacatcatgtcaggcttatcagtcttcatttccatttcaccaaccacaccaagagagacaagaaaaaaggctaaaagaagaaaaaaaatcaaattgagaattggctaagcactaatctatgaaaccaaaataagcaagctcagttgagttaaacttcattaattgagattattctctcatatgtaatggttaccttaagattcttttaatgtttttgtggttttcttgctttccaagtttgcaaaatatcaactgcaaggggaaaaggtgtttaaaattttaaaataaagcaaggaatggatagaatctgaggttgacacagattgtccaagtgccaggttatatttacagaggaaaccaaaattacatttacaagtgaactaattatttcttagccatgtaaaggtttttaaagtaatgattctcatatcattttcatggattgcctccaatactttccactatataggtgagaagctaggtacctttaactcctttataaacaataaatgaactgagtttccatgtgagagtgatttgccaaaacgcctcagctatgaatatctggatccaaatgtgtcaggagaggcttcttgctgtaggaacaacccccaaatcccagtggcttcacccaacaaaagttcatttcttgcgaagactgaagtccactataggttgtctccatggtagggagagataggtgtcctgtctactttcttcttcaaagacaaagcacattgaggtcaccctgaccatcaacatttagctgccaaataggatgatagagagagcgaggtttggaggagtctaggtacacataataggcatatgccatacatcactcttgcctcaattccactgatgagaactaggaatagttcctaaaagcaagccataggacccattggtcatgtctccaaccacatcctcagtttttgccatcctattggttttctctactcaatttctctctccccatattgtagccccacaatcatggtagtaaatattagtatttccttgagatacagcctaaatattagtatttccttgagatacagatgcatatctatgaggccttctttttattcagaaactaatgtctatataatagtaagtgaaagagaagaagcaggagacaaacaaaagaggaaatgtttttaataaaggtggttttccaaattgagcagtaaagtgcctttgagtgtcttaaaatatctgcgtgttcatgtagcaatagaacaaggctctcaaatgatagcgttggcccccaaaaaaagaagcagctgggatactgggaacctggagagactgaaagatgtggaattgaaaatttacgccttcagggtgctgtaacctcagtcctgggggtccctgtcccctccactccaggcctctgctcaccctactgatagagacaggagccagccaaatgcctaggcagataggggcaggtctccggtaaaaccccaccttcaagccaaaagcagcctgaaggctgaaagactggactgttggtcccggattaaacctgcgacccagagtgagaacttctgttcctatttgcccaccctttcctgattgattctttctgaataatgccttttaaccaatcgagtgttgccttttccaataccacctacagccgacccctcccctattctgagcccataaaaagctccagacccagccacaaggggaggagagaaccacctgactgctgggatgggggaccacccccacatcccctctccactgagatctgttctgttgctcaataaaattcttctccacactcctcaccctttaatgtccagtgtatcctcattcttcttgggtgtagtacaggagcttgggaaccaccaaaggcaactacaagctataatacaagcgagctggagcatgcccttcccagccatgggctgagccagtgcacaagccagattctgctcgagtggccaattgagtggctgtgtcctgcagcaggttagtgtggtcaagcaaggcctgggcagagcttcactggccagagatccccagcttgcaaagtaaccaagaagaaaaatcctacatcactacatccttggatgctactgagatgctactgaatgctactgaagatcactggggtgaaaatgaagacatgtccattatggaatgaaaattcatgtcccctccaaattcatatgttgaaatcctaacccccaataggatagtattgggaagtgggacttttaagtggtgattacgtttagatggagtcatgagggtgggtccccaaaatgggactagtgtctttataaaaagaagaagaaacacaatggctctctcctctaccatgtgaggacacagtgagcaggcactaactatgaaccaggcaaatatccctccccaggaactgaacgttctagcaccttattcttgcacttccagcctccagaactgtgagaaataaatgtctgttgtttctaagctgcctggtttatgatattttgtcgtggcagtcccaatggactaagacagtgtcctcagtctcactgaccctcagctacaaagagtcattgtggggtttaatgctcttcatcttatcaccaagggcaagaatttccaatgtgtgtactttcacctgttagaaaaatcaaggacatttcatttatgttgaacccattgtgtactatgaagctgaaataggttacatcatgggtggcataatatctcttgatatattccctagttgcatatatatgtatatatatatatatatatatatatatatatattttttttttttttgagacagaatcttactctgtcactcatgctggagtgcagtggtgggatctcagctcaccgcaacctctgtctcccaggctgaagcgattctcctgcctcagcctcccaaatagctgggattacaggtgtgcgccacaatgcccagctaattttttatatttttagtagagacagggtttaaccatgttggccaggctggtctcgaactgctaacctcaagtgatccacccacctcggcctcccaaagtgctgaattagaggcatgaaccaccatgcccgacccctagtagcatattaaataactgctattttcattttctgttagtattgcaattaaatctttctgttattaagttctatttggttgttgtttgtatttaagatggtacatgtaaaggcagaatttttttcttttttaagagacagggtctcactctgtcacccaggctggagtgcagtggtatgatcatacctcactgcagcctcaactcctgggctcaaacaatcctcccacttcaacctcccaagttgcagctattacaggaatgagctgctatgcctggataattttttattttttattttttagagacaaggatctcattgtgttgcccaggctggtctcaaactcctggtctcaagcaatcctcccacttcagctttccgagtaactgggattatagtcctgcaccaccacacccagctaattaaatttttagggacagagttttcctaggttgccctggctggtctcaaactcccagccttaagtgatcctcctgcttcaggagaggtaaaatatgtttgtgcataataagatattaatttgtagtttgaaactttatttagtagttttactatgtttgaaagatttttttccgatagttataacattttcatttatgcaaaatatatgtaattatctatttgtcatctgctttccaattttctatttctcatgtttcttgtgtcaaattgctttgagtacaacttccataatactcttcatggtgtggtggggaacatctttcaaaaagttgtgatgttgcaagaatttctatgtttttaccactaaacacaattctcatttctgtctctataaacgtgcatatacaatattaaaatgtttttccaatttgttttctatttgaaaataacaaatcgatgtgtcttttcatgttctatgatgatatttataatttttttctctatgaattctttatctgcaaaatgaaattaatatatttctgttttataatgaattattctttatttctggtgtgaacccccacataataggtatacatttaaaaatgtgctgctatattatactttcaaaatattttacttaaacttagtcacatttgtaaggggagttgctttatagctttcttttgaaaaaggttcttaaatctctgtgcctggaagtatataaaaatcaatgattttttctcctttccctgcattctagaataatgtttttttcttttttgagacggagtttcgatcttgttgcccaggctggagtgcaatggcgcgatctcggctcactgcaacctctgcctccagggttcaagtgattctcctgcctcagcttcccgagtagctgggattacaggcatgcgccaccacgcccggctaattttgtatttttagtagagatgaggtttatccatgttggtcaggctggtctcgaactccccacctcaggtgatccgcccaccttggcctcctaaagtgctgggattacaggcgtgagccacactgcaccaggccagaattctttctttctttattttttgagatggagtcttgctctgtcacctgggctggagtgcaatggcacgatctcagctcactgcaacctctgccttccgagttcaagtgatctcctgcctcagcctcccgagtagttgggattacaggcatatgccaccatgcccggccaagttttgtatttttttagtagagatggggtttcaccatgttggccaggctggtctcaaactgctgacctcaggtaatccacccgcctaggcctcccaaagtgctgggactggttacaggcatgagccaccatgcccggccccagccagaataatttttttaaaacactgaaatgatctgtctttcaaggttttaatagaacttgactctcaatgcactgggctttggggtattagggatcactccctgataatttcttatgcttcctggcaataattacacttggttttcaaaatccccttggagtcaggttagtaattcatatttttgtagataattattttgtggaacacaatccataatgcacccctcccatctgtgtaaatttcattgagtttctgcatccattgtgagtgagtagtggagttgctcacaagttctttcaatgatgaggtttccagttccgttgctggatctccttgttggtttgtttgtgttcagggaagagatgcataagagatgactgtgctcattcataaaccacccattcagtctttcctaaaatctcactgactttgcctcttcaatattcacagtccttgattcttctaccatagtgactatgagacatgtgtatacaaccttaaaggaagattccatgatggtgccagacatttgtctctcagcactttctaaacgtcagcattctccaagcttccggaatggacgcacctccatacttattccaaatccttctctgcaacaatctttatcaaaacacttgagagttacctacgaccacattcatacatttctatcctgagtttgttctttttgttgcttaaatttgcttatatctctcgcttaaaacatgacaaaaacatacttttacatctctttcatactatgtttgcttttctatagtccctaaaatgctaccaacattcgtctaggtcttctttaaccccttccttacttattcccttgcatttaaataattgccaagtaaacaactgataatctgataattatgcagctgtttgggggctcatccaaaataattatatggtggttttgttttatttctttatatcatcactagggaggaaaatcaaagaaatttataagcctggtgtgtctgggtgaacaaagctttgaaaattctgtgatatctctgtggaatgcatgaaagctgagatccgtgtgatagtacacttagaatgtatcagggcttatcatagcaacactccccagaagtgtggtattatgaataaatcttattttccaggcagattccaagtttattaggatgcagtgcaaggctctgtatttcatgttatctttctcaaatactaagtttcaaggaaactactatttaagagtttgaaggaagatagacacacacacacacacacacacacacacacgcacagagttaatccctgaacaactccagggttaggagtgccaccttcctctgtagttctgtagttgaaaatgcatatatacgttttactctttgaaaacttaagtactaatagcctactattgaatgaactccttactgataacataaacattcaatcaacacatattttttatgttatacgtatcatatactgtgttcttagaataaagtaagctagagaaaagaaagttattaagaaaatcataaggaggataatatatctactattcattaagtggaagtgaatcattgttatggtcaatgagtaggctgaggagaaggaggaagaggaggggcttatcttgctttcagggctggcaaaggaggaaggaaatccacgtataagtggacccatgcagttcaaacttgtgttgttcaagagccaactgtatatgtatggagagagagaatgagagagggagagaaagagggacacagatggagatagatagatgatagatagatagatagatagatagatagatagatagatagatagagtgaatagatgaatggatgaatggatagatggatgaatggatggatggatggatggatggataaatagatacatatgattaatggatatatagataggtatgatttatggatagatagataggcaacctcaaggattgaaatcatttcaaacagtgactaggaagatcatatatattctagaattaaagaaggaatatgatgagtgagtaatgtcttgcaactaaaatgtttagatcacaagttggaaccttgcctgtgagccaaaactaataggatgaaatttaaatgggataaacatgacacgcttgtgtaacatgaacatgcaatacgtagaagattaccagtgacattaatatgaatatcccagatgtcatagtgagatgcagaaaaggtagacttctgaaaaatttaaaaggtctttgcaccgggtatttcttgctcttttctgtcttttttgcattcatatcaattttctaagtgttttttgatttctttatgaatactaccgcttctctattgcatgtagcctggggtgatggtaatccacagatctttttttgtcccccagcctagggtgagcacgtggcatacgacagcttggggagatacccccttccacaaatttaaatcttgatgagaggactggaaggcttggagagtgttgaccctctgagcctgtttattattattattattattttttcctttttagagatgagatcttactcttacccaggctggtcttgaacttttgggctcgagcaatccttctgcctgagcttcccaaagtgtggggactacaggcgtgagccaccacatccagcctctccaaagaattctatcagctgcatcttgcttaactaaactcttccacattgaggctttcattgtagtttctgctttctgactcctgagtacctattcctaagcccagttctgtagtctcctactaatcctgagatggtcagaagtccttccaaaaatgcactctttctttacttactaaaccaaagctctttcctccagccaaagaagctccactcttactcatgaacatcacagttcatgtgagcaataacatccacaggctgaagttttctcctaaccctgcagggatcttcatttatttgtcattcactaagaactgtgagtgcttattctgtctcaggcattgttctagaagctctggatactataagacagttgtccccaacctttttggcaccagggaccagtttcatggaagacggtttttccatggaccaggggttaggggatggtttccagatgattcaagcacattacattaattgtgccctttacctctatcataattactttgcaatatataatgaaataattatacaactcatcataatgtaaaatcagtgagagccctgagcttgtttccctgcaactagacagtcccatttaggggttgtgagaaacagtgacactagaaacatcaggcactagattctcataaggagcacacaacctagaccctcacttgaacagttcacaatagggtttgcgctcctatgagaatctaatgccgttcctgatctgacaggaggcagagctcaggtgataatgccagtgatgaggagtggctgtaaatacagatgaagcttcacttgcttgcccaccactcacctcctgctgtatggcccggttcctaacaggccacagatccactggggacctctgaaagaagagacacagcagataaacacagctgctctcgaggaaaaattggtcttagatggggaaacaagtcatcttattcattctttaaattttgataacatcaagggataaaaactaattttaaagaactatcaaataaatcccttctaatcttaagtgttctgctacaatcatcctcagtatcagcgggtcggggaggggacttgttccaggacccctatggataccaaaagccatgtgtgggggccaaggcccttggatccctaaaagtttgctgaaaatcatggacatgaggcagattgattaataggataaaaggcatacaaatgcatttaatgtgtatacatgggagccttcagagtgaagacccaaagatacaggggaattgtccatttttatgccttgattcaacaaagtatggacagccatgtagaaataggattggataaaaatggcctaatctaatgttaaaaacattaaagaatttttaaaaatactaaatttgcagtgttgcctaccttccatcatctccatgggaaaaattacttaaatgagaaaaaaagattatttcccagtaggacgattttgtcaccaatcacagagattctctgacaataatctggttgtccctcaaattaaaatgtgtcaggacttgacctcaacaccacaattaatcacagcttattttaatgtaataaattagaaataggaacaccacagtatttattaatgaaacaaagtcacaataaaaaaagagtatgtcagaaatagttttaaaaagtccttctatgctcttcatagctgtgggctcattttatagctgcttgtttttcaacacttttttggtgttttagaaacattttcatttacttcaaaaagttccatgtattccatattcattttaatctcaggatcttatacttcgatagtcatgatgcagtaatttctttttaccaaattaatttcagacaaaatagtcttgttccttatgacaagcaataaaaattgatttttacctgtgtattttagtgaatccacttaaggtccttaaatagcctcaagtaggttatgtgggttgttctaacagacaatgacattacctacatcatggtttatttttactatctcttgccaacaattttaattattggtgagatatcacattaggtagttcatgtagaataaaatagatacaaattgggtattcttgattaaattatagctattcataaatatagagtaagtcaactatattacttgtatgttatattagatagtgctttcacaatacatatacgtaaaatataaagaatgatcacattcctggtttactaaaaaacagcaagtatgtataaaaatagcattttaattttttttatgatttactaatatacagagtaattgatgatatcgatctgctgtgggttgaacatgagtaacatctctttgaactcagctgcaacatctgtgaaaatctgtatgaggttatctactgtatagggctgcaatgagaatggaataaaataatttaagaaaagagcttttccagtgtctcataaatattaaggggtaaagaaatgacatttataatactaagtgctattgtacttagttaattttgaacactgttacctcatgccttgacttctgtggggttaggcttatatactaaatggatatcatttgctcatatgcttaactatattaatgtacaatcaaatgctcaacaaacttttaaacttagaggaggctgggcatggtggcccatgcctgtaatcccagtactttgggaggaaggcgcagaaggatcacttgagctcaggaattcaagaccagcctgggaaacaaagtgaggccccatctctacaagaaatacaaaagaaaatagaaaaaaaagaaaaattagccaggcatggtggcacaggcctgtagtcccaactactcgggaggctgaggtgggaggatcacttgagctcaggagttcaagaccagcgtgggaaacaaagtgaggccccatctctgcaaagaatacaaaaagaggaaaagaaaagaaaagaaaagaaaagaggccaggcgtggtggctcacccttgtaatcccagcactttgggaggccgaggtgggtggatcacaaggtcaggagatcgagaccatcctggctaacacagtgaaaccccgtctctactaaaaatattaaaaaattagctgggtgtggtggcgggcgcctgtagtcccagctactcgggaggctgaggcaggagaatggcgtgaacccaggaggcggaggttgcagtaagccgagatcttgccactgcactccagcctgggcgacagagtgagactccatctcaaaaaaaaaaaaagaaaagaaaagaaaagaaaagaaaagaaaagaaaagattagctaggtgtggtggctcaggcctatagtcccagctactcaggaggctgaggtggtaggattgcttgagccctgggaaggtcaaggctgcagtgagctgtgatcatcccactgcactctagcctgagcaacagagcaagactctcttaaaaaaaaacaaaacaaaacaaaaaaaagaaaaagaacaaaaaacttagagaatatccctaaaaccatgaagccacgcattttgtattatctttaatataatgttaaaatcattgccttttaacattttagttctcatttttatgcacagtaataatttagattaacctgttttcttttgtgctggtatacttgcatatgtaaactgaatataatataaattacattaaaaaattgtatacatataagttgtattcattttaacattatagttttcatttcttacatatagtcataatttaggttgatctgttttattgtgtactacatttatatattatataatataaattttatgtgtttcatatatatgaattttataaattttaacatttcatttttaaccttatatacattcatgatttagattgatctaaattttattttgtgctacatttttatatatattaattgtatataagctatgcacatagttttgtaaaagtttgattactttttcatttcattatatcttttatttccagaagtatttgatatgcatcaattttgactcattgaatatgtcttcttcattgttcatcctaagttcttcttcatttttctctatttctacatatgttctactaatttttttaaacaatgaatatgtcataaatttattcatctgtgaaaacttttatatcctaaaataggtgtttgccacatttgcacctggaacccttaccagatataacacatgaggtcacagatattattcctcaatagctatcttaatattgtgccatcattttcctgcattttgtgtcgcaaaagggaagtttcagctatattaggcaacctgtccacacccacaccactctttatacccttgtataatatttttcattacaaatgcagtttaaaagctatgcctgagagtgcttaggtgaaggtgacatctcccctctgcaaaaggcaatgatataatgatagctgtgattttttttttttttttttttttttttgctggtgatagctgaaccttggttagggcgaataaagctgaagatacctatgaaggattctcctttgcagaatattgtaaatgagtgtggctgtgtgttccttcacacacatgcatatacagaaatggatgaaaagaagactggccattctaatattgaaaattcctgtggaaagactttttgtttcaggtataaaatccatatgagtgattttggggcttgtaaaaatggtctgatcattgacatgttttaatcgtttgcattagcaaatagcatcaacatattgaacctgagcttctaccaccaccatttaagaggtaatggcattaaaaagagacacaaggaataaatttttcttggtctgatgcataagagctgtgggtggaaaaacattagtaaaccttaatgaaatggactaaaggtcagcagacgtgcagtaatgataaatatgtcctttgttgagatgttgccttagggtcaaaatcaatcctgaaaactataagatcaggaaaagctattcacagcacatttgaatccagcctccttacggagaaaacaagtgattataatttttttgcattctagtttagaagaagaaaattgattatttctgtatttcccccttgtgaatataagttattctattataaaaacacacgcatgtgtgtatgttcattgcagcactattcacaataacaagacatggaatcaacctacccatcaatgatagagtggataaagaaaatgtggtacatatacaccatgtaatattatgcagccataaaaaagaatgagatcatgtgtttttcaggaacatggatggagctggaggccattgtcttttgcaaattaatgtagtaacagaaaacaaaataataccatatgttcttacttgtaagtgggagctaaataatgataacacatggacaacacctatgtcgaggggaacaacacacactgggacctaatggagggtggagggtgggaagagtgagaggatcaagaaaaataattaatggatactaggcttaataactgggtgataaaataatctgtacaacaaaccccccatgacacgtgtttacctatataaaaacctgcacatgtatctctaaacttaaaacttaaaaaatatttcccccttgttctaacaacccagtaaataactcatttattgtaatgactgatgttaataaaacagcttcattcccttgaaagattcagacagactaaagggatgggagacaggccagttgcccagaacttgatccacagtaccccatcttgagtctattttaattatagaaaaatccaaacacagccaatgttgcattatttcaaactattttctaatagcaaaataaggtggtgggagagtatgatgaatgttataatttaggcaggaacattttatcatcatgcagtcattaattattatcacccaaatcttttctgaacatctgcctccaattcagtgcccaatttacagcttaagccaagaattgtataaccagagtgagctgcctggcttggtttgtacacataagccttctggaaaatattttaaaaactcttgaaagcttcggcaaatttcgtggggaagagacaggggctactaaaaactaaattttacattttaaccaaaacaaacttcttccacaatctcatctgcggctgtgggtcaagagcttttatatggtttggcttgtttggggaagggtgagttagacttgttttttgcctaaaaatgagcatactgtttttgtttcatatccatatttttttttgttgtaagacgaagaacttttggcttgtacgttatggaaatctgatctctaacgtggttcataaaggaggtctcctcaatggtctagtaatgtatgtcaccgtgaacacatacagggatttatttgaaaacacccctgtttatttttagatcctgtatttgtggagcctgtttgtatttttggatggaagcattgcaaatcggaggagtattctatctaccagcgtggctaaaacactgatattctaaaaccaggccgactgaaggcatactttctcacagcattttaaaagcacacaatttatagtgtatacttttgaaccttggctagggaaaataaagttgaagatatgtatgaaggattctctttttcagaatattataaatgagtgtaaaagttacacattttataatgcattatttgttttaatgttttcaaattctctcacatatagcatcttgcactattatctcccacacatgttgacacacgttgaagaattatgacatcctagtaggaaggaaagcaatgagcaaagataaacactcacttagctatccagatttttattatcagttcttatgaacagaccatgttaaaagatgtcttcgatgtctatatattaatcattttctaaaatgatatatttccatatttgcaatggaaaactattgcaaaggaatagagacaatctgcactcgctctagtgccccatgcttcctgtttcttctttcttttccactctccccttttaaatatatcagctcttggaaatgttaattcttcataatcaaaaatatttaagcacatagataatatatgtacttataacattagaggttttctaggtgagatttctagctgttgagcaaagtatgattttaatcttttttttataagacagagattgaaatggtcaatcagagtggaacaaagtatgtcacaaagagattctcttacatctatgagatggtccagctgcagatactcttcggaacatcaaagtttatgtatttagaatgttcatcattccatgtaagtctcaaacctgtttcaggaagatgaacagggatcattttcagcttcaagactaaaacgtgtgacagaatatcaattaatttccgtaattcatcatattgccgtgctattgtgtttgcattattgattatactgtgaagccacagtagaatggtttccagcatttaatgtgaactactgaaaaaacagaatgctgtcattaagaatgggttaaaaatgatctccaggcaacaataatctttaggtgattcactaataattttattttcttcatttcaaagcccatgcatttttccctccatctttaaaaagacttacttttttattttttatgtttatttatttatttatttatttatttatttatttatttattttgagacggagtcttactctgtcaccaggttggagtgcagtggcacgatctctgctcactgcaacctccgcctcctgggttcaagcgattctcctgcctc[134 bp omitted]gcctcccaaagtgttgggattacaggtgtgagccaccacgcccagccaaaaaaaaaaaaaaagatttacttttaaattacttcctagaattctttaaattgtggcctagataccccaagaaaaggaaagtttacatatcaccctataattttcaagcagtaaatggacaaaaccattttatctaacctctctcccaaggcagcaacctatttcaaaatcctagcaaactcataattctcaggacaaccaatttcattcaaaattgatagactttttttttggttttcatgtgattattattattttgaaactttaaaagcagttttagctttacagcaaaattgagtggaaaatacagagatttcacatatctcttttattttgtttttgttttgagacaggatctcactgtcacctaggctggagtgcagtggcacgatcatggttcacagcagtctctacctcccaggctcaggtgattctcctgcctcagcttcccaagtagttgggactacaggtatatgccaccatgcttggctaattttttttttttttggtatattttcgtagagacggggttttgccttgttgcccatggctggtctggaactcctggtctcaagccatcggcccgtctcaacctctcaaagttctgggattacaggcatgagccacaatgtctggccagctatacatctcttaaccatacatatgtacaacctccctcactgtcaacatcccccaccagagtggtacattttttgcgactgatggacctacgtgggaacgtcattatcatccaaagtccatagtagtttatagtaggattcattattggtgttgtacattctgtgggtttggatagatgtaaaattgcatgtacccttcattatagcatcacaaagaatagtttcaccaccctaaaaatcttgttctccacctattcatcccttcttctccccaattcctgggaaccattgatctttttactatcttcatagttctccagaatgttcctatacaatatgcagccttttcagactggcttcttccacttagtaatatgcattttagtttcctttgtgtctctcagggctttgtagctcatttcttttgggtgttgtattccattgctggatgcgctgcagtttctgcatttacctgttgaatgacattggggatgtgaattccactttaaggtagataaaatttgcactagatatattccctggagcttgggtacacttgcctatcccttcttacgttgctcagctgctaaaaaaaattccaagctcataagaatcttgtggtttcctttcctgtgtatgaacatataaatctgaagcttacaaaagaggctgctttcacccatcataataatgagtgtttaatgatgcgtcaatcaactgtgattcaagacctgagtaatttctcagttcttatgaggagactgctgtccagcacattggaatctcttcagagagtgagaattatagttatgaggctttgaaaaggaaatcgtttaggtattactgccgtcattgaatgttttacagattatcatcgatgtcctgatttttgtccatgcctccaagagtaaactcttaaagagggacaaaacataatctgaatcaatggaaacctatgattagcaattctgaatttttatgccaattttggaaatgtctgctagggaagaaaatggaggtaagttagtgccggtaacacggaagcggctttctcaattgccagtctttgggaatagagaaatacgtaacatagagatggaaatatttctgtattttcataaaataatggatgagctgtcatcattcacagccacaggaaaatgttggcagcccaagcagaataagtgagaaaagagcattatacccagtccctgcttaatgaagctgagagatgaaagctactcaatcatagtatttgaccaccacacctggattctctatattaaaaaggcatttatctaataatccattgcaggctattaccagaaaccgagaatggtgttactgatggaaagaagatggaaaagtatctaagaagcaatatttcctcactgtaataaacctcaatgaaggatcgatctttcaaggaaaattgttggttttgcattttgcatcgggctgtcaaactcagttataggcaggataatttagccaaatatccagcactcaaagttaatgaagtcagaatatttttcttttatcaagtgatttttacacaaaataatagcttggtgattgaaagaaaatttcatattactaaaaatgtgagagaattaatccgagaaaaatccattacccaatttataccttactctggaatgtatcaatatgtctgattaaaataactagttgcaaatgttaaaataattttgttcattttctaccaccatggggaggagataagagattctatcaaccaaactaattcacaatgtctatagttattattggactattaagtgattctgaggaaaataagcccagaatgttttttacagcagcattcttcaagtaacagaaaaatagagagggaggttgtaaaatacaaggaagggtgaaaactagacatctggaattaggctaccaattttgaaaagtatttttgtttgagtatctcttggttgatgactacatacatgttaaacatagcatttggaggctgtgtttgaaacatacggaaatctgcaacaatgcacagaaacagctatcacactgtcaggtctcagtgagaatgcttttagtggcatcagttcaaaatatgaaatagctatttccattatgcccatgttctctgtgtaagactgtgaaccttactggaccttatatatgttcacaccacacacacacacatacatatatacacacacacacataaatacataattacttaatataacaacacatatcattacataatatgctaaatattatctaatataatatttacatattacatatgtattcttttatataaataaaatatacacatataaatttaattatatatgtatattatatttatttatacataatatttgtatataagtatacatatataattcatatacacattgtaatatatatttacattgtaagtatataatataaatattatatttatatattatgttaatattatattatttatatattcatataatatttattttatataatatttatatatttatttatataaataaaatatacatatataaatataatataaatataatatttctatattaatattatatttattatataagtatttctatatataatataatataatatctttatatataatataatataatataaaatctttatatataatataatataatataaataaatatagaaatatatttatttatatgtctgtattatatttatacataatatatataagtatacatatatatttctatatattatatttatttatgtacatatattttatttatttacatatagtatttatatataagtatacacatgtacatatacacattatgttatatgtaatatttatattattgtattatatgagtatttataataatatttatgtgcaagtatacatataatacatatgcacattatagatgacaggtgtgccaaaatctcacagatcaccactaaagagcttatgtaaccaaataccatctgttccccaataacctatggaaataaaaaattttaaataaggaaatatgtgttaaaaaacacaattatgggaaaattattaagaaaaaggctacccaaatgacatttaaatatgccttaatccatgttatcagttttagaagctgcagaatatagacaagcatgcacttaaatgggaataaaataatagtgggacatgttagtggtctctgtcttgtgttcatatgggaattttgcgatgttcagtatcaatcagcctccattactcagggttcagagctgagataatgcctgtggccccccttcattcaaagagatctttgacaaaaaaaccacaaaacaaaaaacaaaaacaaactaagatgtgtaaagacattccataaattacatcacgacctgaaaatggtgcctattgggttaacaagactacttcatactgaagttactgtttctttgtagaaagccctttacaagatgatgttatgttgaacttttaaattttcctgcttgtcccactaagactagactctgacacgaagtcttattttgtatatttgttaatttggagcatgaattgctgtcttaaaatgtattttctcaaaagtatgtgccctcatttctcatgttgttgtcctgctatttgttatttagctttctcagataatctgttgactggccttaacaaataagaaaaaaaaattaaacagagtcagaaaaattcataatgcatataaagtcactacttcttcaacaccctttcttcaatctggaactattcactcagttgactttaccaccatgcacccagattccttcattctaagtgtttcctctgccactatttaatccatgttattcttaagacctgtttgcagttttccaaacagctttttaaaatgagtcttacatacattattcttataaactctaatttttaacgagtaccagcttacctattcctaaatatagtaaatgtatgttcattgtgcattcaaatattgagagtccccagttgctcaggctgataaggcactacatgccatgttgtcatctcattcattcatgcttttagaagtacaaattgagaacatatcagctaagatgtctgctccatgctgagaatagagacatgaatataaaagtcataatcttcttcttttttgagtcaaagtctcactccgtcacccaggctggagtgcagtggcgcaatcttggctcaccgtaatgcctacctcccgggttcaagtgattctcgtgcctcagtcttccaagtagctgagattacaggcatgcgccaacatgctcagttaattttttgtatttttagtagagatgaggtttcaccatgttggccaggccggtctcaaactcctcacctcaggtgatctgcctaccttggcctcccaaagtgctgggattacaggtgtgagccaccatacccagcttataaaaggcataatctctttcacttttaaacatgagtccagatcaaaatatctagaggtctttttttgcaacatatgttaacacgatgctgtgatttgcatgcttgtgtccttccaaaatttatctgttaaaacttaatgcccaaggtgatggtattaagaagtgagatatctggaaggtgattattttgccctcatgaatggtattagtgccttcacaaaaaggctaaagggacctagctagactttttctgccttttcaccttctaccatgtgaggacacagaatttctacggcaggagggcacagcaacaaggcaccattttggaagcagagagcagccctccccagacactgaatctgccagcaccttgattttggacttcccagcctccagaactgtaagaaatacatttccattcttaaaatttgctcagcttcaggtattttgttatagcagcccaaatggactaagacacacaattttaacctatttgtcaaagaatccaaatacacagaatgtataaagaaaactgtgaaagtcttccagatatatttctatgaatctatagatatctggttttgcaatatgatttcttcaattaataatctgtcatcaatgatcttgtatgtcagcacatgcagagagatcttgttttcttttatgggatcataatcttaaaggtatattttatgctgtaatttgaaatattgtgcaatttggtatgggaattgaaatttctgtattgattgacactcatatattttaatttagcttctgcatgttatgtaaagatgacactggttttactcacgatggtagagatgatggatggaagatgcaaagttcccagaacttaaggtagtgagagaaaccagatgtctgaataaaagccatgtttctcgtatataaaactccatgattttgttgtcatttaccttgaaagaatcctaaaaggaagagaacataaaaaagagggtgtgtggctgggtgcattggctcacgcatgtaatcccagcaatttgggaggccaaggtgggcagatcatgaggtcaggagttcaagaccagcctggccaatatggtgaaactccatctctactaaaaaaaaaaaaaaaattagccaggcatagtgatgcccccctgtaatcccagctacttggaaggctgaggcaggagaatcacttgaacccaggaggcagaggttgcagttgcagtgagcaaagatcacgccatggcactccaacctgggtgccagagcaagactccttcttggaaaaaaaaaaagaaaggagggtgtatgtgttttcccctccctgtttggggggagggagaacattaggaagaacagctaatggatgtggggcttaatacctaggtaatgggttgatctgtgcagcaaaccaccgtggcacatgtttacctatgtcacaaacctgcacatcctgcacatgtgccccagaacttaagacaaaaataaaaattaaaaataaataaataaaaaggaaagaggatgtggatcaggagtctaatttcagacattctctgcaagaaaagtcattaattgtatgttctcagaaaccaaagaattatgacccttgattctctttacactaggcagaaataaaatttaatctaatcatttggtgtgggataataaggggaaggtaccaacaaaagccagaaacaccaagaattcaggaggccaattggggtctgaaaacctctcctggtaagacaccccctttgtggggaatctctgattctcagggaaccagcactctctcacacatttctactataagaggatgattcttctttctgttccatcttcctggcagtttcctcattttctggtctctagaaatgtaggtgtttatttattg[176 bp omitted]ccaccacgcccagctaattttttgtatttttagtagagatggggtttcaccgtgttagccaggatggtctcaatctcctgaacttgtgatctacccacctcagcctcccaaagtgctgggattacaggcatgagccaccgtgcctggcctaaatttaatcactttaaccatttttaagggtacatttcagtggcatgaagtccattctggttctggatccagcaggccacttttgcactggcaatgataaactttattctctcaaatttgctgggctcaaccccttatgggagggagcacgcaggtgagtgggtgccagggcccgggtgagcactttctgtcctcatggcagcatctggggctgtgttacaattaattctcttttagctttgccatctgtggatggcttaagtgttaaacaactcaatgaagagtcagtttgaccgcctttttggattcctgcactcagtgcatccagaattcttgtctagggtccaggaaaaatcaggtcacatgaatggtttgaaaggtgatgaatgcagaggattttattaagtggtggaagtggctctcagcagaaggggagctggaagtgggatggtacaggaagaaggtgatctttcccagaagccctaccatctctgttcgggctcctctctgaagtcatgctgttctgaagttaagctgcatctatccatagtctctgatgctcagttgcttcttcttctcttgacattcagccacttattcctctgccagctgagatctggggtttatatgggcacaagatgcttgggtggcgggccaaaaaggtaacattttggtaggaaagcagggataactgttctcatttagggcggcagtttccaggcttgagggtggggcctttgccagggagccgccctcttctacccagtatttccctgcttcttgtccatatcaccaccatcaccgccatccatctccagaactctgttcatctcgcaaagctttatacccattaaacaataacctcctgttccccactttgtccaacctctggggactatcattctactttctgtctctatgaatttgagcattctaggtacctcatattaatgaatattcccttgaatgtatgtaccacaatttctctagccattcattaatcaatagacacataagttgagtgaaccttttggctattgtaaatgatgctgcaatgaacatgggtgtgcaaattcccacttccaattattttgggtctatacctggaagcagagtttctgagtcatatggtaactgtatgcttctcttttgaaggaactgttatactttttggaattcaaggttttaagaaagcttcaggcagggaaggaaaacttcatctttggaatttctgagtgagatttgttaccaaaacaacaacaaaattttccttaattctgcctcaggttaaagggtgttgtattagtctgttttcacactgctatagagacataccgaagactgggtaatttataaataaaagaggtctaattgacttgcagttcacatggttaaggaggccttaggaaacttacaatcatggcagaaggggaagtaggcacatcttacatcgcagcaggtgagcaggtgagagagagagcacatgtgtcagtgcaggaaaaactatcatttataaaaccatcagatcttgtgagagttcacacaatatcatgagaacagcatgaggaaaactgcctccataatccaatcacttcccacaaggtctctcctcaaacacctgaggattacaattcaagatgagatttgggtggggacacaaagtctgaccatatcaggtgtgtttcctgaaaaacacagtcaagagatccttgggtagagggagagtgagaatttgaggaacaactcaaagattaggatattattataataaagtattctgcactataagccttccataaacatactaagggattattatttgtgtacattaaaaatgctctttcattttagggatatacatacccattaaaatccattcattccaatcccagaataaaagcttggcattatctccaggatttaaaataagaatgtcactgtagaaattcccaaggatttcaaaaccaacatcagctctttggtatatgactgctcccagtacaatcataatttgacctaaattttgcccctttccaagaattctggtatcactcatgagtgtttgcttgctgtctggtcttaccagtcacattatctcttggtataaatggtaactggctgtctatgtctttgcttcctctcacggtactttgtttaccaagctgcagatattcagggtgcattgcccaatggacaatgaagagacagtggctgggctgtttttggaggcaggatccctaagatttgacatctcattcttgatgccatccacgtccaatcagacttgaacttcaggacatttctgcagatgtcttacaaattaagtcactgggtcttttttttgtttcttaatgcatcctcctttgatctcacgtttagaaattctatttgagatcctgcttttgctggttatcctaccttggccacatttctaatgagcaaattcaacagggctgtgcaaggaacatttttcaatgccaactcaaattctgaaatgtatttaatattcatactctgatctcaggtcacttcatgttaaacatgacaagctgtcttgtggtagtagcttttacttataaatgtggatacattgttgaattctcaagtattctatgcaaaaacggatcaagcttcttccttttctgtgttcccactctactggagaatagaaatcatggagccaggttgtaattctccttttcctatcagacttttgcagtaaactgtgaactcctcaagggcaaagaccctttactgctcatttctggaattccatttttagcagacagccttgtaagaggaatgccgttaatatacattgaagacatgaagcaaagaaaacaagagagggaaacagggagagagaaggaggaaggaagaggtggggagaagagatggaggacctgtttatagactgatgtcaagcaagttaaaacacatagttcaaggttttcatttttcatttttccaaagacctgcagttgaccttgttgaaagaagtttgccattttttagccactgaagcctaagaacatcttcatattgtttatgtccattcatctgatgaatctcttctttctgcaagccctttaaaaggagtcactgatttttagaaagggcgggtgcagcttgtggagctggagggaagttcctaaacaggagtggctctagttcacaggcttgtagagtccataattcccctcaaggctgtggaatttgtgatgtatatgcctggtgtgagctcagtgagacccagataacacacattgtcacccctggtcacactctacctggcctttttttgtttttttatggctctggtgtgttgggagactaaagtacaccttggaattctgtcttacaactggtctatccattgtaaggtgaggacatgtgacaagaagcttctcaagtctcagccaggatgtcttcagacatcagctcctactggggtcaccaagaagccagtcagatagctttggagaatgataggtggatgctgagtgtttgcatggctggttagctctgtttgtttattcttgctcatccaagaaaatgcagccttccttttatttctcttttctccattgatccctagtgctgaaattgatgcttttagtcaaactgaattcatagatctatctaacaatgatatctcatcattaggagactagaattattattagtcaatatttgccagagaaacagaaccagtaggaaatggatgtatagatagattgataaatagatagatagaatagatgataggtagttagatttgattgaaagatcactagatgaaatagttgaatggagggatggttggattgatggatggataagatagaaagacagatgatagatgaaagattatagatagatgatatataatagctagataggtagctagatagtgagagagatttcatagatcagtagatggtatggatagatggataagataggaagaaagataatagatagataggacagataatagatggtagacagatgatagataaatgataaatggatgatagatagatagatagataggtagataattgatagacaaaaagatagatttgatatatcaacagatgggatgggtggatgtagggataagtcagcaaggcagatgatatatatatatatgggacacatgatggatatataatagattgtagataaatgatagatagatcaatgattgatacatagagacatacatacacgtatacatacgtttattaaaaggccttggttcatgtgattagggaagctgttaagttcaaaatctacagggtggtctggcaacctggagactaagttgagccaatgttgcagatagagtccgagggccacttgttggcagaattcattcatggtctgggtaagtcagtcgtttgttctattcaggccttcaattgagttgatgaagatcactcacattatggacagtgtgatggttaatattgagtgccaacttgattgcactgaaggacgcaaagtattgttcctgcatgtgtctgtgagggtgttgccaaaagagaataacatttgagtcagtagactaggagaggcagatccaccctcaatctggatgggcaccatctaatcagcttccagcatggctaggataaagacaggcagaggaatgtggaaggaatagacttgccgagtcttctaacctccatctttcccccatgttggatgcttcctgtcctggaacattagactccaagtttttcagcttttggtctcttgaacctacaccattggtgtgcctagggctttcgagccttcagccacagattgaaggctgcactgtcaaagtttccctaattttgaaattttgggacttggactagcttctttgctcctcagcttgcagatggcctattgtgggatttcaccttgtgatcatgttagtcaatacttcttaatgaactccctttcatatatacatctattagtcctgtgcttctacagaaccctgactaatacagagggcaaactgctttactcaaaatccaaaagtaagttaataataaaaggatattatcaataactttatggcaaaaattttgactatgtacatggaatggaaaatctccttgaaacacatgaactatcaaagctcaaagctcaagaaaaaatagaaatttgaaatagcacatctattaaacaaataggatatgtggctaaaaaacttcttaacaaaaatgagcaaaaacaataagacaagcccaaaaccaaaccaaacctataaacagtgtaagatggattcattggtaaattctactaaacacttaaggaaaataatgcctattgtatgcaaattctgccagaaatctgaagaggaggaaatgcttcaggattcattttatgtataaagcacaatgaagtgctttctaagtttttgctagtgtcctggtgtacaattttgttctatttgctgtttaagtttgaatcttgtctattgtacattctgaaatgttagagtcatttttgagaaaagaaacacaagacagtatagtaaaaatacagaaagtcaattccttcatgaacacagatacaaaaattataaaaaaaatttagtatacatatgtaaacatttaataaattgtatattataaatacatgtaatttgtcatgtcaattttatctcagtaaagctgtccaaaattgaaatcaaatagaatgaaataaaaatgctgtttttattagctctgactttcaaaatgcaagtcagtttatttcatttctcattattctgttttttttctaattctttttcattatggtgaaatatacacagcatacaatttaccatcttaggtatttttaagtgtatggttcagtggtattgaatacattcataatattgtgcaatcatcaccaccattcatctacataagtcttttcatcttctaaatctgaaactttatgctcattaacaatgacttcccatttccctccacacatcacctggaaatcactcctctattttctgtctctataatcttgactactctatctaagtagaatcacacagtatttgtctttttgtaactagcttatatcacttaacataatgttctcaaggttcattcatgttgcaacatgtgtcataatttccttcctatttaaggctgaataatattactttgtatgttgtattaatccattctcacactgctatgaagaaacatccgagactgggtaatttacgctgcaaaagaggtttaatagactcacagttccgcatgactgagaggcctctggaaacttatgaccatgatggaaggcatcttcttcacagggtggcaggagagagaatgagtgccgagcgaaggggagagccccttacaaaaccatcagatctcgtgagaaatcacttactatcatgagaacagcatgggggaaaacacccccatgattcaattatctcctcctggccctgactttgacacgtggggattattacaattcaaggtgagatttgggtggggacacagagcaaaaccatatcatatgtatagaccacatttttcttatccattcatcagatgataaacacttagatggcttccacaatttagctattgtgaatgatactgttatgaacataagtgcataaatctctcttcaaggccttgctttcaactctattgggcatacatccagaagcagaattattggatcatatggtaattctatttctaaatttttgaggaagcaccataatgttttctacagttgctgtactattttacattcccaccagcagtttacaagagttctaatttctctatgtccttgccaacatttgttattttttgcttttttttttatagcagttattctaatgggtgtgaagtggtatctcattgtggttttgatttgcattttccttttcatgtgcctgttggccatttgtatatatcttctttggagaatatatgttcaaatcctttgcccatttttgaataggttttgctgttgagttttaagagttctctatattctgaatattaatttcataacatatataatttgcaaatattttatccatcccatgagttcagcttttttaccctgctgatattgtcttttgatgcaaagttttttgtttgtttgttcgtttgtctgttttttaaatggagtttccctctgctgtccaggctggagttcagtggcacgatctcagctcactgcaacctccacctcctggggtcaagcaattctcctgcctcagccttctgagaaggtgggattacaagcccctgccaccatccccaactaacttttgtatttttagtagagatggggtttcaccatgttggccagggtggtctcaaactcctgacctcaagtgattcgtctgccttggtctcccaaagtactgagattacaggcatgagccactgcacttggccaaaaaaattgactcagaatttaaaaaaatttatgaagtccaaattgtctattttttttctattgttacctgtgtctttggtgtcatatgtaagaaatcctgaccaaactcagtgttgcgaagctttttcccctatgttttctattaagagttttatagttttagttctacatttaagtctttgtctcattattcttcaaggaaaatgagcttagaatttgtttttatattgacaatgttgacacttttaactgaaggagctattccacaatcttacggatgcctgactagtattgttattttgggcataccacttaggtttccaacgttagtcagttttcttaacatattgagtgcacatggatgttacattttctaaaagcatttccacagatccttcacctaaattagtgcactcaatcctagtatccacccaagcaattcttaaatacatacaaatgaattaaacaacattagaggtgagaaataaagactgaatgggtcatggaaggcttgtcccagaccacaaatctagtaaatatgaaactggaggataataagatgggatttgagaatctctacatgcctgcccagtgttttccatacaatcatgctactccttcatgagtcattagtacctatgcttttctatattttatagataattaggtcataggcataagattttttggtataataaaggaagaatcttcatggttcatatgtttgaacttgaaacaatttattatctaattttaaaagaagcttcaaaatttgaaaaatagactcacaaaatattgtaaactcaagaaaagaaaactaaacagaatatgagaatttttgctcaatctcttacagtgcaagttgaaaaaaagacctaacatactgtgaaaaaaggagcatgttttcagcactattctactgattccccatactggaaaatttttgttttgtttcgtttttcttatgttccatctgttgaaagtcttaaatattaagggtatgaattttatttatttttagtttcttaaaatttttgtggttacaaaaataaaatcaaaatggattaaagggtatgaaatttggatattggaataaattgatatacccaatgctagctattatgacatattttcttccaaaattatctttcattcaaagctcttgggatagtttatgatctagtatatttagtgtaaatattctcataatatgtaaatatttatagatgtattcatatattatacaaatatactctagcatatttgatgtaagtttcttaggatgtggttccacatcctgaaaaattccactgatagacttctgttttcctatttcaataaagccataaagtagttccgaaaaactttcaataaataaagctggacactgaaagatttggtctgaaaatgtccttgtccattaatggtaaatattgtattttcttagtggccatttgaaaatttacaatcagatgatcattattttcagatgtagtattaacacgatcaaaatagcatcattagattttccttcatgttgtgattttcacaataaaattctcaaacactaacctgggggtcattctaaaatatttttaatatgatctgaagttccaggtgtaaattacaagcttcctaaaaagtagaaccatctcactcaactaaacaacattgcctttaaaaagtttaagacaatttcgattgaaattcctaatggaagtttttccagcagaagtcagtgaaattttattgtctatattatcatttttatggaagttggaaaacctctagagaagtgaattaaagttgatctttttgcttgtaataaaataaagaccatcctattttacctaaggggatgtcttcaaaatggcttttaaagtaaaactcataaaagttaaaaaaaaaaaaagtaaagaaatctagggagattgtctacataattcattctctctttccctccctgcctccctctcttcctcattcttctctccctctctatttttctttccttcacttttttttccctataacttatgtaactagcatggcttaataaactttggacctttttgttcacctgggctcttctctcctggaaagaacagtgtctcgtatcccgttccaccagccctggtgaggtaatctgcagttagcaagatgtaagttcacttcctaacatgacaatacaaatcattcttcaatatcattctttgcagacgatggtctaaacttcacaaccttattcccaagtgagctcaagttcaccattcacatagcatttttctaaacagctcaaaaaccccagtaatttatgggctccgctctggcagagctaaaatggaaatgtggattatagctatcattttcaggttcagagctggctgtgtcagtacagattgatttgtaagtgtccgtttccgtagccatagccaataggtagtgttttattttgtctttccccaaatggctactctcacagccacagaaacatatgagcccattagtgtcgcaaatgctttataaaaattggcttatttgagtctcccttgaaaatgttcccctgaatatgatttttctctgcaagtcatgattgaatatttttttaccaggtgggctatgtttggtggttgtctagattcatcgatatccataaggtaagggaataaatattaacatattctgggttattaataaaacatactgatcagtttatatgattcattgtgttacatttttagtgctttgtgaaatttgtgttcttggcttaaatgcttacagtgtaaaacagatgcaaattaacctagcatttgcctaaaattcgcctggggtctacactgcatctcctgctagtgaggagagggtggacggatgtgatatagatcaatcatacagatctatcgtacaactgaccagcatacgtaatcttttttcttcccaatttttccatctccttaccctgatgattatcttcacgaggtttcatgatgcccgatggttgtgtttctgtgtttgttgtcttgtatttccttttatcagatttctccccgaatataaactttgggtatctgcctttccattcgtgtaacctttgagttagcacttggtatgcagtgggtaaacaatatatgttgattggatttaaaaaaaaactcagtcaaaagtaccagagcttgttccctctatgtcagactagacaaaatcatttgaactaataccccataatggaaaaaacttctgtaatgaaaatgggccacagagaaaaaaatgtgtttgtgtgtacatatgtgtgtgcatgtgtgtaaaagagatttaatataaatatatatatacatatatgtacttatacatacaaatgcaatgcacatatgtatgcatatatatacctctatatagccatatatatgtagattgtattcatattggagacagatatataggaaatatatatatctacagagatagacagatagatagatagatagctttacagctggaaatctatctatatttgtttatttgtttgttcattgttattgcagggacttgttagttgttgtcaaaacattgacaaatttcatgaacacagaaagtggctggaaggaataaagtagactaacctcaaaggaccaactgttgctatatgcacagacattataaggagaatattaataacattaaatgacagctcactgaaaaatggaaatagtacaaaaccttttttgtcttcaaaggtttgcaatcaaaggagaagaacattttaaatagcctgataaaataatttttctattacctatgaggtaattcagcacagttttaatttccattttatttacattagtctttggaatgttgaaaggcaggctttatcttagacagttcctagaataaaaggtaaattcccatatgcctctcagtccttaaccagatccacctttactgggaggaatagagaatgaaaagaaaacagggaatgtagtaccagttttcaaaatatttaactaagcttcttatctatatttttatatttaaatgattctagaatatccaagtgaccaagccagaaccttgctggacacaggaactctgttttcttgttatagcacctacagaatgtgacaccatgaagactaataataaatgcttcactatacacatacatgttctagtgcatgggatatatgtagaaatcatgggtgtgaattcaaagtcattcatcttttaaatgaaataagtattttgaagacatgtgtgcaccactgatatggcttggctgtgtccccacttaaatatcatcttgaattgtagttcccataattcccatgtgccgtgggagggacccagtaggaggtaattgaatcatgggggcagttacccccacgctgctgttctcatgatattgagtgagttctcacgagatctgatggttttataaggggctattcccccttttgctcagcacttctccttcctgccaccatgtaagacatgcctttgctcttcctttgccttctgccatgattgtgaggcctccccagcaatgtggaactgtgagtccattaaacctctttttctttatatattactcagtcttgggtatttcttcatagtagtatgaaaatggactaatacaaccagcatgttcatgacagcaaagatttggaaacaacctagaagtccattgacatacagatgaatcgagaaaatatgtatacatatttatatatgtcatggaatgttattcaaccttgaaaaaaaggaaatcttgtcatttttttaacaacatggatggacctgagggatattatgctaagtgagatgggccaggtgtagaaagacaaattctgtatgatcttatttattcatttatagatggcatccaaaatagtcagactcatagaagcagagagcaaatgctggttaccaggtgggtggggaaggagaaatggggaggtaataatggtcaaagggtccaaactttcagttatgcagagtaaattagttctagagacctactctctagtatagcgcctaggacaaacaatactgcattttatgtataaaatttactaagagggtagatatcatgttaaatgttcataccaaacacatgcacacacacacacacacacacagagacataaaataataataataaagggagtgggaggaaactttaggagataatggattgattaatatatttataaccttggtgatggtgatggtttcaagagtgtatacttatccccaaactcaccaagctgtatttgttaaatgtgtatagctttcaacgtgtccatcatagttcaataaaatggttttaaaaacccacaaagttattcatcttctaaaacgcggcttttctccagctaatttaccccttccatgcagtagaatatgaatgtgatagtgacaaaccattttctagcaactaaacaaggatgcctctcctgggaatggggaaacagggtggaagatgggtatattctggaaaattctgagtgaatccagagaacagaacttttactctctcaaaacacccatccgttcagacatttatgtgcaagaagtaaaagtttcatcttgggcaaagtactgttgtttggtccatggagacacatgaaagctaataacattttttattagtgataaagaaataaaagcaatgtttgttaagagaacaagaggctcaaagcatcagcaacacacacaagggtagctcagaaaggattcggtagagaattaagaccgcacagaaccagagaactatttgagacataatagttgactctgtgtttgtatatctagtcaacagatacatcattactcagaaatggaaattgatttcagaagtgtcttttatgcttttgttttctaagtgtgtatttaaagatttttagtaacgtctataaaaggccatagtgtcgcaggctaggcctcactaacagctgagcaggcagacctttgtaacaactgtttcagcactgaccgagtggtgaagttaagtattaaaagctgaaagagccagcgcccttatacaaaggctggaatgtaacaaaagcccactgagagttctgcccaggcctctcctaggccttgaagcatgacaagataatgaagggattcttaagaggacccatttaggatcaaacaagttttattggggatctgaaggaactccccagacctccacaaacaagttttattaggggtctaaaagaactccccaaacctccatgatttagcaggaaacaagataagggtaatcaccccaggcacttggactcatctagattaagtcaattactgaggccccagaggagggtctccaggactcagaccttagttatagattagaagaagttaatcaccaatgtctttagatgaatgcacccttatacgtagacatatagcttagcaggtatataagctctggaaaactttgtaatttgagtttgcctggcgatattttccaagtcttctccctgtacgcggttatagaagtaaactctcttcttttcccagttcgtctgcatgtcattattgggctgtgagaataagcagcctgaccccgtggttcggtccgggaacaatagcttctgtgatttttaacacaccttttttttgtcctatttgagaatcctttcaggtattgtgactttcttggcaaactttgcatctggcaaagaaatagctcaaggatgtgtgtactaagaatacttttgttatccataggggttgtcagcaaaacaataatactcatcaacttatttattttctaacaagaaaaggtctttttatttcctggcactttgaagatgtcccttatatattgaaatgatcattttgatttaaggatttttcttatcaaaatttcatcatgagttttctaatgaatgttgaattgaaaaagaggcattatgactccacaaactcttcgacttaacatttcctaacggttgattgacttgtttcctggttgcctctttcctaagatacatacctctctttctttactccccattaatttgagaaagaatatcaatttctgttcttgtcccaccaattttaagttatttaactccttgggacaggtctgtgaagtagttgaatcattccatgagaaccttcaccatccactagaaatgagggtgccggtgacctgaaagaatcttactgtaaatgaatatggtaaattttgagattatgggtttctaaaattgtaccaatcacttaaatgtctaactggaaaaagtaatgctctttctaaagttcccgattccatctacagatgatataattattgggtgtcgggaaaccttcactgtttccctcacagtgactaaggtagatttgaaaacctaaatttacgtgtgcatttgccaactaaatatcttaatataaataatatccaatccaatttactttgctacatatctgatgttaataatgaaaaagggaaaagaaattcattctaaaacaccttgtgttaataatatttctgtctgtgttaagttcactgaatagtttccttacatatgcatgccttccttttagaaatggataggagatggtaattttgtttaaaataaggggaagaaaggcatctctttagcttcacctttgtttgttaaattcagtgaacacacaactgaatgtatgagaccagaacatacaccacagcacggctgggagttaatcctccattgcctttgggagaattttatgagaaggaaagatatccttgtactctgacaatgtgaaggcctagggaaatagaattcaaaggacttctttaatgtgtagtcttcatgaaagcttattttaatatagctctgagtgattctgtgaatattcaaaatctcctctgcactcaaaattaaattaagaaaagaaaaactactgtgttgatgttgtggcctaggtgatcctatgtgatacagaattcataaaaaaataaacaaaaggcagagattcacttcctataaaaagaagagaataccttaaactgcatatatattcgaatatgacgttttgacttaattcagtgaatcaaccagctacctcatctaatccatagaaaaactgcttctgcattgctcagctcaggagaatcaaataaaaagtgttcatgttttatttttttttaatgcctagtggctgatagcatattaatttttgccaaagttaaatgtccccttttttactttagaatacatttacatttagaatacttactgagtttgttaagacagaaaaagttttgttctatataatctaagttatattttagaaaagaactataaattgaaatacaaaattaaccatttttttctttgagcattttttgtttctttccttctttggcatttctgtgttcatagttgaagttggcagttatctcctggtacttagtcaatcagagccctctgtcatatgcttttgaagtctgagaattacaagtaaatacaataaccggtggtaagacccaatattttacaataaaaattattatggtaaaccttaatacaaaatgaaaaaaaaatcacaaaacctccttaaagaacatatgaaacattacaaatatatgtataatctatggaagtagtacataatcatcatcattatcttcatcagctttgaagataagttacacaaaagttttgaaaattaatcacctcactcctccttaaccagtgggccaaagacaaggtgattattaaaatgagaaaacacaagaattgaatgacaatgaaaatggtacatctcaaaactgaaatcaaggatattaacattaagataccttaaagaaatagaaaacaaatcacacactcaatgaagttgcttgcaagaatttttatggacaaagcactagaattcccaaaatagaaattattcctatgaattgattggggaaagccaatacaaatagaaaattttgtgtagtgtgttagcctgttctcatgctgctaataaagacacacccaagactgagtaatttataaaggaaagagatttaattgactcacagttccacatggctgtggaggcctcacaatcatggtggaaggcaaaggaggagcaaagtcacatcttacatgagaaacatttgtatttaacatgttttcgataagttgtttaaaatgagaaacatttgtatttaacatgttttcgataagttctattttgcaccatattcatgttattctttctgatttctctctgcctgtattgatacaacccaaaactgatcattcctttactttgaactttctgaataattttctttatctatgcttgtttaaaggttgcatttaatcaatagtgtttttgatgtaattattatctttctgcttttataggtgaattcaacataaattcatttacgtagccatgaatgatagatgtaggtacactttcaaaaattaaaaattttaatttgtgcataaacatgttttatttatttatttatttattttattttttttgagatggagtctcactctgttgcccaggctggaatgcagtggtgtgatctcggctcactgcaagctctgcctcctgggttcatgccattctcctgcctcagcctccggagtagctgggactacaggcatccgccaccacgcctggctaatttttttttgtattttcggtagagacagggtttcaccattagccaggatggtctcgatctcctgaccttgtgatccgcccgcctcagcctcccaaagtgctaggattacaggtgtgagccactacacctggctgacatgttttattaatgaaaaatatgtagtttttcattacaaagcattacatttatgtatatttaatatccttaattgtacatatttatatatatacacacatacatatacatacacgtagatatatagattcatggaaatacacacacacacattatatatatgtacactacacagaaatgtacaatttaactctttttgatgtgatatgcatttacttttgaaaaatgtgaacataaacacaattttttcaccccacctatcttctacttattttttaattggtaaaaggtggtgtttcagacattgtaatattaaataattattttgtattatacattgtattagtccattctcacactgctaataaaaatatacccgagactgggtaatttataaaggaaagaagtttaattgactcacagttccacagggttggggaggcctcagaaaacttacaatcacagtggaaggggaagcaaacatgtccttcttcacatgttggcagcaaggggaagtgcagagcaaatgcagggaaagcaccttacaaaaccatcagctgtcatgagaactcactcagtaacacgagaacagcatggaggtaactgcccccatgattcaatcatctccacctggtccctcccacgatacgtggggattatgggaactacagttcaagatgagatttgggtgaggacacagccaagccatatcacacatcttgtctttcaaaagacatttccgtaatatcctgcaactacataattattacaccacatttctttagccccacacttcataccgatgacatcagaaatgttcatcttgacttgtgtgtacatttctgcctccctcacgctgttgtcttgttatcttattgttcatttcttctttcatagaatttttcctaccttcaactttattgaacagaacaagtagcctctaaccagtgtttattattgcttttgtgtgatgtatttttccaattatgctgtctcttggcagatggattgctaatcattccagttatttaacagcattatttctatatttttatttccatagactcagctggatccaaaatatattttcattgttgtttttgtttctgggtgttaacattttggagcttctaactgtctaagagaattttgtgttgtcatcaaagacaaggttacttgtttatcctgggcatgacagtgtgtcttggttgtcagaagttgcaagtagacaaaggaaatcgtttcctaacaaatctctaaatgcaattcctggaggggaatatttggatataatgtttgacatagatgacatatgctgctggatattgctaatgttttgggttttgtttgttttttgtgtttgtttttgtttttttgagacagggtctcgctctgtagtccaggctggagttcaagtggtgcaatcatagctcagtgcagcattgactcccaggctcaagcaatcttcccacctcagccttcagagtagctgggaccacaggtgcacaacaccatgcccagctaattgtttttctttctttctgtctgtctgtctttttttgctagagccgaggtctcattatgttgttttctctatcttttcctaccattcccatctgttttggggcttttcttcctacccttagcagctttacaagggatcctgctgccttcctgccttgagttcattcaggtgcccagttgtggagaggctcccgcagctggcctggtgcctggcgtctccttttcccccacctccatcaagccatgtccctcctgaatttgatcgttcacagcactgctggcatctagccaagacctggacatcctagatcaattaggcaaaattcagccaggtatactcttatctacaagctatatgccttagaataagaattttaatgccgtgactcataaaatcctggaaactcaaaaccctgccaattttattggcaaaatatctggttcatgggagcaaatgattttgcctagagagacagtccttagctatcatctgacttgaaaagtagttcatacccaacacaaaaacaatacaaaatcaccacctttagatacaacagatggagaagaactattagaacaggacagggagttgagtatgctttcactttgggtgggaacataatatagtcttcatgatggtgtagatttagggatgtaaattaagttacacacagtcttagttgtatttcagggttttttttaatagtgttgaagcttgcctttctctgtgtcacttatgttcatattattaaagaatgtgagtagatagaaaacataaaacgatatatgtgcatatatatgttcatatataaacgttatatatgttcatattttaataatttatacttataaacattatccggcatgatagtatgcacctgtagtcccagctatgtaggaggctgaggcaatgaggcaagaggatcgcttgtgctcaggaattcgaggctgcagtaagccgtgatcataccagtgccttccagcctgggtgacaagagtaagaccctctctctaaaaataaaaaaaaatagattataaataatgtgtatttaaaatttatttttatttacaatatgactgtagcctcagcaatttgcaactgtaactagattacaataaatataataaaaatacattaccagcctgggcaacatagtgagatcccatttactaaaaaaaaggaaaaatgtagtcaggcatagtgcccaggaattcaaggctgcagtgagctgtgattgacccactgcactccagccagggaaacagaatgagaccctgtctcataaaggaagaaaacactatatatacacatacacacacacacacacacacatacatacatacatatataaaaaaatactatatataaaatattatatatataaatatatatatacacacacacacatttttaatatggatacatctgctataattacatgcaaaaataattacataggtatatacacagtataaacttttccacatgtgctttatatatatatactatatatatagtatatatactatatatactatatatatagtatatatactatatatactatatatatagtatatatactatatatactatatatatagtatatatactatatatactatgtgatatacatatagtatatatacacatatatactgtgatatacagtatatatatacacatatatactgtgatatatagtatatatatacacatatatatactgtgatatatatcgtatatatatacacatatatacatgtgaatatatatactatgtgatatatacacatatatatactatgtgatatatatacacatatatatactatgtgtatatatatacatatatactatgtatatatgtatgtatatgtatatgtatgtatatgcatgtatgtatatgtatgtgtgtatatgtatacatatatacatacgtatatactatgtatatatacatatatatagtatatgtatgtgtatatatactatatagtataaatatactatatatagtatacgtatactatacatatatagtatatatatactacatatatagtatatgtatactatatagtatatatacacatatatgtatactatatagtatatatactacatatatgtatatatactatatatgtatatatggtatatatagtatatatgtagtatatatacagtaaatgaatataatatatatacatatataccacatatatactatatatactatatatatactatatatatagtatatatagtatatatagtgtatatatactatatatactttatatactatatatatagtacatatatactatatagtatatatgtgtatatataatatagtatatatgtgtatatatacatatactatacagtaaatatgtgtgtatatatactatatggtatatatatttgtgtatatataccatatagtatatatatttgtgtatatatactatatagtatatatgtgtatatataaatatagtatatatgtgtagatatttactatatagtatatatgtgtatatatatactatatagtatatatgtgtatatatatactatatagtatatatgtgtatatatatactatgtagtatatatgtgtatatatatactatgtagtatatatgtgtatatatactatgtagtatatatacatatatagtatacacacatatatacacacacagcatatatatgtgtatatatatactatatagtatatatgtgtatatatacactatacagtatatatgtgtatatacatactatacagtaaatatatgtgtatatgtacatactatacagtatatatgtgtatatatattatattatatatttgtgtatatatatactatatagtatatatgtgtgtatatacaatatagtatatatgtgtgtatatatatactatatagtatatatgtgtatatatgctatatgctatatgtgtatatatactatatagtatatgtgtatatgtacactatatggtatctatatgtgtgtatatatacactatatggtatctatgtgtgtgtatatatacactgtatggtatctatatgtgtgtatatatatacactatatggtatctatatgtgtgtgtatgtatatacactatatggtatatatatgtgtgtatgtatatacactatatagtgtatatatatgtgtatatagtgtatatgtatatatacatatagatacacatactatatagttacttttgcatgtcaggaccaaatgcatgaggcgttttctattatgtactaggcactggacaaagctcctgaaatataattgttaaaaagcagatttactcattcatatttgcctaaatcgttgcaatgcaattttgatttgttattcataatacaggattattttgaaggaaacttaaagataaaactattgtatagaagtatttggttttccatattatgtaaatttataattttaattttcaatcacaactatttgaatacaatcataacattagttactgtcaggagtatatattttgagcattcagaggactagatctggtattaagttgatttctttcctaaatagctgggaaactttgggaaagtcatttcagcctttgattctccttcagtggttgctccataagtgaaaataaaaactcagatatcatggagctgcagaggaatttaatgtattaataagtgactatgcagttaaattgtgttcagcaaggtctctgtcagtggccattgttcattttaagacccttttattataaagtaccatagtgaaatcaaagtaaggaataaataacagttttgaggattgatgtgatggctgcagcctgtaatcccagtactttggggaggtcaaggcaggagagtccagaattttgagaccagcctgggaaacagtgagatcccatctctaaaaaaaaaaagctaaaaaaattatttgggcatggtggtgcctgcctatagtcctaagtactcaggaggctgaggcaggaggatctcttaagcccaagagttccaggctgcagtaagctacgatcacaccattgcactccagcctgggtgacagagcaagaccccatctcttaaaaacaaaataaaacaaaacaaaaacagttgttgaagacaaaatatgctatatgctccaggagttacaaggtgatggagttctgatcatgtgctgggctcttgactcagcctctcatatgttttacatacatactcacagcaagccagtgagataagagcaaagacttttaaagtcaaagggaatatgtcttaatgagggtaaaagcaaaattataaataattagatgggtcactcagaaaacaaacaagaacagctaagaagaacatccatgcccttattaaacataactgccttgctgtgtaaaaccttctaaggtttttaggcagcaagaataggtatcctcagaacggcagaaacagcaatccgtgggataaagtaattcttttcagtgggaacattgctttaccagaaagggtggggatttcagttcactgtgaggaacaagttggatttcagtacatagatatgttggaaccattcctggtaaataaaagcctataaaccaaaaatgaaactgtaagccccccagctgaatgaatggacccttcctttcagccaagggaatttcaaagaaacctgaaaaactattttgggccataattggaaaaaggggggtcagacatgcctcattgtattctcctttcttggggagtcaaacacaactgatcagcattcactttaaaacaaagatcttaagactgatagaacagactctttgtagcaataagttagcaaattccaacctgactctggtataccatcatatgacaaatagcaggccctgaaagaaatgaaactattttaccctaaaatatatttatttgacatatttttaaatggccctacaaagctgtctcttgtaggggaaatatacattctgtagagaatcccattttcattccagattttttccgatcctgaagagactagctgagagtctggcatgttttaggtatctgaataggaaacatttggcatctactgcctctaagggtagccacctatgagacttcatctacataataagaaccttgttctccacaaccccttgtcttaacccagacatgcccttctgtttattccaggtcttgagataataacttagctctttcaattaaatgtcaatcagaaaatctttgaatccacctatgacctggaagtccccactttgcattgtctcacctttctagactgaaccaatatacacctcacatggattgattgatgtcttatgtctccataaaatttataaaacaaagctgtaacccaaccaccttgggcatgtgttctcaggacctcttgagactatcccttggaccatggtaagtcatatttggctcagaataagccttcttaaatatttgacagagtttggctcttttcattgatagtccttatataggtcctacagattctaggcttcttggcagcatggtgagagtgaaaattatataaccagaaaatgaaccttaagtgaaaggggtgagtcatgtttagatgtagttaaatataatagaaatgagatttttgtgcagacaggaaaggcctgaagtagcagaataaaatattttgagtttgatccagcagaaaataggcaagtttcagagaaagtgggaaacacaattataatataatacatttcacttagggagtttggattccccaaacggagaaggacgaagtacatcacaagtactaactactggagtcaggatagcaaaagaccacatttataaagagtgaattggggacatctggtgagatactctaaactgaaaagcagtgattaaatttttcatttgcaacctcaaatggaattttcaaactcattagagaaacttaaataacatgagaaacgataaaaaaggatgactgttctgcagaatctaaattatgcagctactgttatgatcatggagataaaaactaaccatgaaaatgacaacccattgcattgtgaattgtattaagctaaatagagaagttagacttacacagtaagaaatgataaaattcactctcccttgtactcactgaacaaatatttattaagaggctttaatatgctagagatcatgagaaatactaaaatatatagctttggaatgacccccaaggggacaaaaaagtcagaggaaaagataaaacatttaaaagacaataaacataaggatgagtacttatatacaaacttctatgtgcattaattgcaaagagaaatcacatttgttctgatggaggaaagcactgtcaagagggaaaaattaaatataagtaagaagagattaggtgaacagagtgaacaggggctgctagtgagattggaaggggaagcatatcagagtacaagtgaaatacatgttttattagcattgatagagttcagctgggtcaactgctgctgataaggagaatgtagcctggggaacacagccagaccccacctgtacacaacatacaaaaattagccagacatggtggcacatcctctggctaatcctctggggcaggaggattgcttgagcccaggaataagccaatatggcaccatggcactacagcctgggtaacacaatgagaccctgtctcataaaaaaagaaaagaaaaagagcaagaaaaagaaaagaaaaggagattgtgaggaagattgagagatgacagacgggtgtggctacaatttggttgaaattctcaagaattgctcagtggcatcatgggaaacagtctgataaaattggactcaagagaaaataggtgagaaagggagtagataagaaagaagaggacgacgaagaagaagaaaacacaaaaaatgggattagatttgctatgtaatgtgctattctgatttttatttatttatttttttgaaacagggtgtcactctgtcattgaggctgaagtgtagtagtgcaatcatagctcactgcagctttgaactcctgggctcaagcattcctcctgcctcaacctcctgtgtagctgggagcacaggcaagtgctaccaccctgagctaatttttttttcttttgagacagagtctcactctgtcacccaggagggaatgcagtgacatgatcacagctcactgcagccttgacctcctgaggtctcacctcagctccctaagtagctgggaccacagccacttgccaccttgcccagctaattttttgtagagacagggtttcaccatgttgcccaggctggtcttgaacttgtggtctcaagcaatttgcccacctcagcctcttaaagcaatgagattacaggcctgaaccaaataatggtgaaaattaatgtataaataattgtatcaaaaatgattgattcaagaaacagaaattcacttgtaaaataattttttggcaggccaaaacattttaacttaggttaaattgaagaagagatagaaaacattagttagacatctgttgtaggaataaaaatacaagataatgctgaggcacattgtgtgaggaaaaagaagggatttcactttctctgtgagaacattatttagcacatactcaatgctagaaaaattgctagaacacaaggaaataagatttttttttttttttttttttttgagatggagttttgctcctgttgcccaggctggagtgcaatggagtgatcttggctcactgcaacctccgcctcctggattcaagtgattctcctgcctcagcctcctgagtagctgggattacaggggccctccaccacacccagctaattttttgtatttttttagtagagacggggtttcaccatgttggtcaggctggtcttgaactcctgacctcaggtgatccacccgccttggcctcccaaagtgctgggattacaggtttgagccaccacgcctggccaagactctatttttttaaaggaaatatcaactggcaagagacgcaatgacaacagcatggaagataggtcagtcaaaaacagctcaaaggattcaaccctgcctgtgaaaatgatgcgaccattaaaggaagagggaagttggtaagaggagttggtatcaggaagatgatgattaatttgttttgagacttgttgaaatttaggtgatttcagggcagccggttgaagatatccgagagacctttggaaatgtgaatctagagcaaaggaaagaggccaaattgcaaatatctgattagggaataacttgcatgaaggtgctaattgacacctgagaggatgcattagtccgtggtaagagaaaccaaatgcaaatagatttcatcagaagaggccatttatcatctgggctagctgagaagtccactgagagactgtggcttcaagcagtgttaaatccgtagactcagggacaaaacctgataggtactgtgggtccaaggtgcctgccctccccctgcaaagctttgatgaaaaatcgactcacaaaaaaaagattaataggagaaaaagcatacaaacttacctaactgtgcacatggggaaaatcacagtgattgctcaatatcccagtggagtgcagaaacctatatgccatcttgaggttacagaaggaaagggggcttggattctagcaagacaggctatgtgagggggagaagaggaattctattcaaggccaatatatgattactagggagaatgattggatcaggaaacagaaattaacagatatatctatcacctctacaacaagttaccacaaatctaatggcttaaacccacagctatttgttaccgcacagttgccgtgagtctgggcacagcatggctcaactaggtcctctgcttgggtctcacaaagaaaaatcaatgtgtctgcagggctgtgtttttcacttgaggctcaggggaggtcctccttccaagttcactgaggttattggctgaattcagtaccatgcagctgtataactgaggtcaacacttcctggctggctgtcagctaggagcctgtttttgctgacaaagaccacctatgttctttctcatgatctctgtatgggtttctccagcaacagaaggttgagttcctctaatgttttctgtactgatttttcttctgccacacaatagtccccacttatctatgggagatatatttcaagaaccctagtggatgcctgaaaccgtggacagtactcaacctatatatatgataccttctcctggacatacacacctgtgataaagtttaatttataaattgggcacagtaagaaattgacaataataacttatatggtttggctgtgtccccactcaaatctcattttgaattgtagctcccataattcctacatgtcatgggagagacctgatgggaggtaactgaatcatggggctgggctttgcctgtcctgttcttgtgatagtgaatgagtctcatgagatctgacggttttataaagggtacttcctctgcacaggctctcttgcctgctgccatgtgaggtgtgcctttgcttctccttcatcttctgccatgattgtgaggcctcaccagctctgcagaactgtgagtcaattaaacctctttcctttataagttacccagtctcaggtatgtctttattagcagcgtgagaacagactaatacaataactaatcttattatataacaaataataaccaattcttctaataaaaggaagaattataataatatactgtaataaaagttaaatgtatatggtctctctctccttttctctctctcttaaaatatcttactgtactatactcactcttcttgtaatgatgtcagatgttacaatgcccacgcgattagatgaagtgaggtggataacataggcattgtgaagcagtgttaggctactattgaccttctgatgatatgtcagaaaaaggatcatctggggggcagggccaagacggctgactagaaacagccgtgatcagaggctcccatcaaaaagaaccataattagcatgtgaatccttcactagcaaccaaggtatccaggttctttcatcagaactgactgggcagctgatgtgaacctcggagaggaaggaagagcagtgtggtacggcagcccacctgagagtcacatggggcaggggagcccccaaccctcagccaagggaggcagtgagtgagtgtgctaccaagttaaaggaactgtgctttttccacagaactgtgcaacctacggattggaagatcccatttgcgaacccatgccaccagagcctagggtcccaaccccaaagccacacagattctcaacagcctctcagctggaatctgcctaagcctgccaagctcccaaggggaggggtgaccagcaccagagctgcagctgcctgctgcgtaagccgtttgagctccttgggggaaaggcagctgccagcactaggactcctaactgcctaacacactaagttccctgggtaggggaagggtggcatccatctcaatagttccaggccatgctttttccctgcttcagtgagggaggctggatggcttggtccccaagaggtgtcccccacagcccaacatgccaactgtggcagactgcagccagagcacctcttcaggcctgaccctgacatccttcctcactggatggggctcaggaactctaacaactttggccagagactcagggacagaacctggatctccctgggcttgatcccctagggggagggatggctgcagtctgtggaccagcagacttagcttttcctcctggtagttctaaggaatccaggcagcccagacaagtgggtttcccccagggaagcacaccccctgcacaaagggacagtcaaagtgcttcgttaaatgggtaccattccctgtgccacccaaatgggtgagaccttccaacaggggttatcaaacaccctgtacaggaatgatcctactggcatcaggttggtgctcctcaagatcagagatcccagaaggagcaggcacctatctttgttgttctccagcctccttgagtgacatctccaggcatgggagtgaaccagatgaatagggcctgaagtgaaaccccaacaaactgcagcagtcctacagaacaggaacttgaccattgaaagaaaaaaacagaaagcaacagcaacagcatcaacaacaaaaaaagtccccacaaaaaccccatccaaggatcagcagcctcaaagatcgaaactagacaaactcacaaagatgagaaagaatcaacaaaaaaatgctgaaaactcaaaaggccagagcgcctcttctccctcaaatgatcacaatgcctctccggcaagtgtgcagaactggacagaggatgagatggacaaagtgacagaagtaggcttcagaagatgggtaataaaaaatccaccgagctaaaggagcatgttctaacccaatgcaaagaagctaagaatgttgataaaatattagaggagctgctaactagaataaccagtttagacaggaacataaatgacctgatggagctaaaaaacacagcatgagaactttgtgaagcatacacaaatatcaatagctgaattgaccaagcggaagaaaggatatcagagtttgaagacctccttgctgaaaaaaggcatgcagacaagattagagaaaaaagaatgaaaaggaagaagcaaagccttcaagaaatatgggacttcataaaaagaccaaacctatgattgattgaagtacctgaaggagatggggagaatggaaacaagctggaaaacacacttcaagatattatccaggagaacttccccagacaagccaacatgcaaattcaagaaatacagaaaacaccactaagatagtccataagaagatcaaccccaagacatataatcatcagattctccaaggtcaaaatgaaggaaaaaaatgtcaagggcagccagagagaaaggccaggttacctacaaagggaagcccatcagactaacagtggacctctcagcagaaactctacaagccagaagagattgggggccaatattcaaaattattaaagaaaagaattttcaatccagaatatcatatccagccaaactaagcttcataagaaaaggagaagtaaaatcctttcaagacaagcaaatgctgagggatttcgttaccaccaggcctaccttgcaagagctcctgaaagaagcactaaatatggaaaggaaaaactggtaccagccactgcaaaaacatatcaaaatacaaaaaccaatgacgctatgaagaaactgcatcaactagcatgcaaaataaccagatagtgtcatgataacaggatcaaattcacacataacaatactactttaaatgtaaacgggctaaatgccccaattaaaagacacagactggcaaattggataaagagtcaagacccatcagtgtgctgtattcaggagacccagctcacatgcaaagacatacataggctcaaaataaagggatggagaaaaatttaccaagcaaatggaaaggaaaaaaaaacaggggttgcaatcctagtctctgacaaaacaaactttaaaccaacaaagataaaaaaagacaaagaagatcattacataatggtaaagggaacaattcaacaagaagagctaactattataaatatatatgtacccaagacaggagcaccatgattcataaaacaagttcttagagatctataaagaaacttagactcccacacaataatagtgggatactttaacactccattctcaatattagacagatcaatgagacagaaaattaacaaggatattcaggtcgtgaactcagctctggatcaagtagacctaacagacatgtacagaactctccaccccaaatcaacagaatatacattcttctcagtgccacatggcacttattctaaaatcgaccacataactggaagtaaaacactcctcagcaaatgcaaaagaacagaaatcataacaaataatctctcagaccacagtgcaatcaaattagaactcaggattaagaagctcactcaaaaccacacaattacatggaaattgaacaacctgctcctgaatgactcctaggtaaataatgaaattaaggtagaaatcaagaagttcttttaaaccaatgaaaacaaagagacaacataccagaatatctggaacacagctaaagcacgttaagagggaaatttgtagcactaaatgcccacattggaaagctagaaagatctcaaatcgacaccctaacatcacaattaaaagaggtagagaggcaagagcaaactaatccaaaagctatcagaagacaagaaataaccaagattagagcagaattgaagaagatagagacacaaaaaatgctacaaaaaatcaattaatccaggagctaattttttgaaaaaattaacaaaatagaccactagctagactaataaagaagaaaagagaaaagaatcaaatagacacaataaaaaatgataaatggtatattaccactgaccccacagaaatacaaactaccatcagagaataccgtaaacacctatatgcaaataaaccagaaaacttagaagaaatggataaatttctggacacatacaccctcccaagactaaaccaggaagaagtagaatccctgaatagatcaatagcaagttctgaaattgaggcagcaattaatagcctactaacctaaaaaagcccaggaccagatagattcacagctgaattctaccagaggtaaaaagaggagctttttacaacaacaacaacaacagaaatttattgcttcacagttttgtttgctggaagtcccagatcaacatattggcagggctggttcctcccgaggcctctctttttggcttgtagatgcagtgttctccctgtgtccttatgtgatcgttcttctgtctctgtgtctaatctcctcttatgaggacaccactccagttggattaggatatagtttggctgtgtccccacccaaatctcatcttgaattgtagctcccataattgccatgtgttgtggaagggacacagtgggaggtaattgaatcatgggggtgggattttcccatgctgttttcactgtagtgaataagtcttatgagatattatggttttataaagggcagttcccctgcacaggctctcttgcctgccaccatgtaagatgtgactttgctcctccttcaccttctaccatgattgtgaggcctttccagccatgtggaactgagagtccattaaagctctttttctttgtaaattacccggtctcaggtatttcttcatagcagtgtgaaataggactaatacacattagggcataccctagtgacttcaatttaccttaatcacctctttaattaaaggccctgtctccaaacacagtcacattctggggtcctggaggctaagacttcaagatatgaatggagacagggaaccattaagtccataacacatttactccagttaaaaaaaaaaaaaaaaaaaaaaaaaaaaaacagggcaaataattgaaaacttttagaggaattctgcgagcacatgtatctagcttttatgcttagttggtttctatattattgtctttggcaagctgatgctaaatgaaaccacttatatatcccatttcccaatatttatatcacgttagtcaattttgttgttgacttcgtagataatgttttcattgtatgtgtgtaccaccattttccttatccattcatctgttgatgaacacatagcttaattccatgtctttgctattgtgaatagtgctgtgataaacatacttttcatattcctgttattctatacaggattccaaagagttggcatggatgagtgatatggttaagcttgtttccccacccaaatctcatctggaattgtaatcccataatccctataatccccatgtgtcaagggagatgccacgtggaagtaatggaattatggggtcggtttccccaatgctgttctcatgatagtgagtgagttctcacaagatatgatggttttataaggggtttccccctttgctcagcactcattccctgtcctattgccctgtgaagaaggtgcctcctgctatgactgtaagtttcctgaggcctctgcagccatgctgaactatgagtcaaaaaacctgtttcctttagaaattatccagtctcaggcaactctttatagcagtatgaaaacagactaatacaatgggggagtcaggccgaccgcctggaaaaccaactgagccagtgtgaagctgtgtaattccagtcaaggcattttgcatctctgagctagagtcccttcatgcagaatgtggcaaaattaacatccacagataagggtaaggtttccatggcaagttaggtatttaacaatagtgaccattaatacaacagcctcacgtaaaacacttcattaaacacagtcttaaggaatctataaattcgaaagcaagatcctttctgtgttgtctttgatagaagttgaaacacttaagagaacattggacagccacacccacagttaaattactaaaaccaatgccgctaatttttctagggtactgggtgacatcttaactgcttccttcactcaagatggctccattctctgctggaaccactgtcaatcttctatatataataaaattttactgccttaaagtcttaaagtttttttaaggcagctgctttccttgacatgtctttttaacaaatgattatgatcagagcccatgtaattctgtcactgttttcaaagaagaaagtttaatctaataacttcctattaaatttttagttcttgcaggagcacgtttgaaggatattcaaggtaaaccatttcacatcagaattccactgctgggtaccatcatccttcctaatgaaaatttatttcaggctaataacaaattctgtcctttgtcatggtgttggggatttttgcccatgagttttttgatatgctaagtttataacggatagtttatgcttgcctaacttattttccatttagaaatgaatgataaatagataaagccctaaagaagaaaaattggattttaaattactcagttgttttattatctatatataaaaataaaaatcaaccatggaataatttagaatgggagctcaactagacaggcattaggtctatcacagatgaaaattagaaacccactctttaactggacatctctttgccgtcttgctccgtcctcactgggtaaatttaggcttaccaagtcagtagatgtgagagagctcaatccttgacaggagtttgaaattcacattcctttggggtcagaaataaaaacatggggaggggtagggggtgtaggatactaatgggtttgtgttcagcttagggtatttataggttgaacattttaaaaagtccacatgcgtgacaaacaatatggatttgtgaacttatacaggtctatatttctttttcttttgtcccagatccaacctctccttgtattagtcttcctatgtctcagttgaaagtttccctaagatgtcagtgatggaacactgaatagcttgtgcatgggttttgcttgaaagaggggccagtctcatttttagtgaccatgagaaaggtgaaatatagtagttatttggtacaatcaagtcagcagaggtggggcggtgcatacagtgaccaataaatgacattttggtccattttcctccttgccaccctctgctctccctcgagagtttccagagcaatatttgggaatcttatgcctccctgtccttaaggattctctctcttcctccattgaatccctgtttgggtctccgctcaatggaaatactctctggctcattgcatcctatcttgtcaacatttccattttctttacataaaaacaaacatataaaacaacaaacccccgttggtgatagcaatgatttaagagaggggacattttaaacacattgtgtcaactacacatgtaaagacattgagcatgatgaatgaaaactagatttccctatggaggagctaaggatgctctctctggtgtctctcttggcattaggttttgcctactgttgcctgcccacatgccctggtctcatctccatcccctgtaccttcaggtctgacggcattgatgtgaagtcagagtacaatatgcctagcagagcaggaacaaactcagaaacaatggaatgcaatcatttttgcaaacacatgcatagctaggaaggtcatggttgttcctacaggaatttgcactaccttctatacaatggagattagaatgagaggaggggacattgtcctttcttttcctggcctgatcactatagggccatgccttggcaatatctcactttttatgccaaggaactgtgcaagatccattgagcaatggatgtgcactcgagccagaaactctgtgtgacaactctaagtatctattgatgttctttctcatagcaggtagtcatagtgccaacccatatctccatggtatatacagacttggtttccttgctaccacaagcttataagggtatgttttttgctttttgtttttgttgcagctgtgcttctgcgaatatctttctttaaatttccattgccatgaatcttggcctgatcagtacttatttcaatggattcctctctgcaccacattgtgtagacattcctaatgtgatactgctcgtaatgttattacattttcccccaaatgctgataaagatagcttcctattttcatatttatgcgactacatttgaaagaatttggaaggcagtgggattgaataaaaattaaatgattttaaagtcggcgaacactcattataatagaaaaaccactatataaatgcgcattataagtagttttgcaaacagtaattgttctgctaatggatatattggaaattgttcatcaattgaacaaaatgatcatttaatcatgtgatataatttggcaccatttttattttgaaaaggtattttcttatgactcaagcagcagtttctatgagttctaaactatatttctctgtgatccaataaagcatggtttctgacacattcttcaaagagaatcttgaatttgtgggcactgacaaatagaattctgcttcaatgctgacctagtttgggtcaaaatgatttatttccctgtagagttgtttaaaggctatgaaaagataaggtactgaggaaaggaagtttgcctttaagaagtcattacaaaatttatagatgcatataattatagaactcgaactgaccttaaagtcagtgtagtctcatcccatcatttttaaaataagaaaaaatgaaaaaaggacttttagtggttcttactattttgaggatcacagagcattggagcatctaattagaagtatgaagacttagaataacttgagcccaggagttcgaggctgcagtgagccaagatcgtgccacggcaatctagcccaggaaagaaagtgagaacttttctcaaaataacaataataataatagtaataataataataataggcctctctctggagcaatgcatgtatgcacaactctccatgggatttttgcgtcttactatagaattttatcacactgaacttttagttgagaacctccggtatcatcagatattccagacaaatttctttaattgggcttaaaagcatgcatttcaggatggagaacaatggtttaggccttcgtccctagaattccctttaaaacacaactttcagctgggctcagtggccagagtaatttcagcactttgggaggccgaggctggcagatggcttgagcccaggagttgggcaccaggttagacaatatggggataacccatctctaccaaaaatacaaaaattagccagacgtggtggcacatgcctatggtcccagctgctggggaggctgaggtgggaagatcacttgagcctgagaggtcgaggctgcagtgagccatgattgcacccattgcagtccagcctgggtgacaaagagagactgtgtcacaaaataaataaataaataaaatagaaataaaagcatgaaacaaaactaccagtctctatctcaaaatattaacacttgtatcccaacagattgtccactttcaaataacagtttaaaatatataattagtgttacattggaattacccataagtcctgttttcttcatttcttatttcttcttttctctttctctcttttctttctttcttttttctttctctctttctttctttctctttcttctttctttctcttttcttttttctctctttctttctcttcttcttcttctccttctccttctccttccccttcccctctcctcctcctcctcctcctctcctcctcctccttcttcttcctcttcttctccttttccttctcctgtttcttcattttctttatactcttatgtttctattatgggtatttgtcaacaagaatgggaaaataaatgaaccctatttcatccacaagacgatcaccatctcctgcagaacaggtagtattaatatttcagtgaataaactctttcctgttccatgctgctctgtgttcagtttccacttcttagatctgaataccattagtaggagtctcaatatgcttaaggatatcctcatggtcttcaagaaagtgaaaataaaaatattgctaattgatgcttaactttcatcattttgaaatgcacatctcattgtggacaaaactcactgtctgcccctgctgtcacttcccacccaaagcaaaggaactttacaatccaagtgcttaaatccccataataatattcacatgttgcctaatactataagaaagagaatatgaagtgttaacagaaagatacattgacaggtttgtaggacttttgttgcctttagatgttatttatttatagatgtttatatcttagaaaatcaaatctaagtgtaaactagcaaaacaaagtgagtcacctctaattttggaaaaaaatacattctcagaatatatggctatacataatgaaatatcatataatagtaaatattatattaatatcaataatttccttgcaaccttaaaaaactccaacatggtcttcatttctatgaaatctgttttcaaatttttgctgaaaaagtaatatacgttgtatggtggttttaaactttaattttgggtgctgaataaagcagtttcatggaatttgtacaaaccacctggtagaaaataattacacccacttaagatgaaaccaggaatgcttttctttttgcataatttgcaccaaagaaagagccctgccaagaactgaaggtatttatcccatagatgggcaaacacaaaaaccaaatattcagattccaaggtgatgttgaccaagagttatggttgtattaggagttatgaaatgactgaagtcattgtacaaggaaaacattctgtatgcactaagatttcccaaaagataaggcacttactgctctgttatctgtatcattaaggaatacctgttggtgaaattggagacaagtgcttcaaaaaagtcatttctactattttttggaagaagacaatcataaaacaaaatatgcatgactgtttcaaatcccagcctacatgacctaagcctgacttccttgagtagaatcactttcaaatatgttgagtcagaaactactaagggaaatggaaatgattccataaacagtctagcaagatctgcgagaccgccaaagggtggccggtaggagaaaacaagacaaagatgtgagaggaattggactctctgacgttgttagttccaatgcatgagaaataaatggaaacaaaaccaatggggtcttcctaactccaaatttttatatgttaagttttataacatcatgactccttgaatggagttatctttaagttatcttggcatatcagaagtttgaatatctacaaaaacactctagtcaccacaaaacttaagtgagtactttttaaagaaatatttaactcagggcggggtgcggtggctcacgcctgtaatcccaacactttgggaggttgaggcgggcagatcacctgaggtcaggagttcaaaaccagtctagccagcatggtgaaaccccatctctactaaaaaaacacaaaaattagctggcatggtgatgcacgcctgtagtcccagttacttgagaggctaaggcacgagaaccacttgaacatgggaggcggagtttgcagtaagccaagacctcaccactgcactccagtctgggcagcagagtgagacaccatctcaaaaacaaacaaacaaacaaacaaacaaacaaattacatctgacagttcatcattgtcaaaataaaattaatttccttttatgtgttaacatttaagatgattttaaactttttttcttactcaattctaatctattttatttagttatgattacaaccacattagattgtaaagctgtcaatcaaaagtgttttgtatcttatactttttggtaagctttttgtgaacttgcttggaaaacataccattcttaataatattgtgttgcggaaataaatattttcttctacgcaaatgactctgagttggacctcaggggcgttgcacatgaacattcataagctagtaccctaccaggctcctgagtgatgcctcaagcatgcagccagactgtgagctatctcaggctgtacatgacaccagggctccagatcgacctatctataactacttgacactttccccgtgcatatccaccatatcacacattcttcaataaatcagcagaatacacgaatcttgcatgcaaagttttgaaatctatctcagaattcacatgcttcaggtaatgtctcctttaaactgtaaattacttcaagcttaaattaaaacgattaagaaaatgtttttaaatctttttcttacaaccaccaacactcattttcttttcaatattgattaacgttctgaagtaggatgcttttaacagacttccaatattacgttatgacagatttttatgacaaccggaggcaccatattttaaaaagattttgtcatgttttctgatttaggtctttagttgttcagaactcaaatgaatcaatttgagtatgtgtaaaattagggaattatggctctcccacaaataattatggctaaaatatactaacacaagttggttaattttatataaatgaatgaatttttaaatgacatgtcctgtcatttttaaaagctgtgacgatctaattctaactaatttcccacatgatcacaaagagctgaaggtatttttatccataagtacttaattttgtgtgtgtgcatttccacaatattgtgcattctttaataaattatcagaatacatgaacttgcacaaaaagttttgaaatagccatgtttttttgtagcacattgctgtaaatcagtgcccttctaggttatctgtttttcatgttcacaactttaaattaaagatgctgttcactgcttgctaatacttggaactacaggaaggaactgctattcaacactcattatgtctggataaatttctgctacattgcttgtagtagatactcatgggtgtctactgaacagacatttctttcttctcttttcgttttttgaaggctgatattgtttaatcaaatgccctgtcaaacacagctttttcttagcccagggcataaggataatgagtcttagccaaagaagagaatctcatttccctttcttaagtgaccagtttaggaaaagtcaggaaaggtttttatggttaaagacatgtaatgaagtctgaaggaagcagtctctgcaaataattttgctgtcttttgaattgaaaaaaatatatatatttgatgtaaatacccaatgtgtatgggtgtcctacaaaactaagattgaccaccacactgaattttgtttggttgttgaggctgataattttacatacacactcagacacacacaccaagaaggtatgaaaaatttattgcttgcacaatgaggctttctaggaagggcagggcgggcttcccaagtatctaaaaatgggtaacgcttccaggaaagactgacttggggcttttaatgtgatgaggggctggtgttggtacacttccagctgtcatccaaggagggaggaccctggcttgtgtacccaattgccctgatgggaggcggaagagaaaaaggtagggctgaagcctggacgctatctgcagtcaaacattagagaaatggaatgcaggccaggtgtggtggctcacacctataatcccagcactttgggaggctaaggcaggaagactgctggagaccacgagttcaagaacagcctgggaaacttagcaagatcctctctttacaaataataaatataaaaaaattacctgggcatggtggtgcaaggctgtagtcccacctacttcagaggctgaggcgggggggattgtttgagtccagggggtcaaggctacagggagctatgattgcagcactgttctccagcctgggcaacagagtgagaccctgtcaaaactgtcagaaagaaataaaggaagagagagagagaaagagaaagaaagagagagagaaagaaagagagaaagaaagaaagaaaagaaagaaagaaagaaagaaagaaagaaagaaagaaagaaaaaggaaggaagagagggaagaaaaaaaggagggaaggaaggaagaaaggaaggaaaggaggtatggaggagtcaaagaaagaaagaaagaagaatggagggaagaaaggaaggaaggaggcaaggaaggaagggagggggagagagaaagaaagaaagaagaaaaaagagaagaaagagagaaaaagagagacagaaagaaagaaagaagaaaagaaagaaagaaagaaagaaagaaagaaagaaagaaagaaagaaagaaagagagaaagagaaaagtggattccaaccctttattgcagccatgtacacagaagcgtgaaaccatgctgactggatgttcagaagccattaggtgaactgaacaccgtacatatagaacacgtagccaccacagacataggacaaaacatgctgaaaggagctgagaagtgagataaagaacccaagataatgtctctgactacctctgtggatctattacatgagataaataagtgcctctattactgaagttgttagtcattgggtaatctctacttgcatcgaatcgcatcctaggtttttcactatcatttttttcaccttgtctttttccatactttcttgatttcaacataaagagtggccacttttaattgtgatggacccacagtgatgccagcttagttcatctctccctgcattcccctgcttgaaggatggccctttgtaagaagaagtgcaattaaaatgtcttgcttgtgcaaaccgtcttctccatttttcttcatttttatttctttggctctttcaagctcacaagagtgtggctgacatcctccaagtaatattttatttcccaatgcctgtttaacaacacagtgagttataaaaagcagacaaattcagaaaaaaataaagaagagaattatgcaagcaagaaaaagatatcaacctatctggaggtaagataggtttgtgtgttgaagaatcagtcaaagttaatgactagatgctgttggcacccatacacactggatatttacatcaagtgcatggcaagctttatctcaatatttcaatgatataatctgtgattttaattaagatgtcagtaatgagtaattatatgttttcatgatataaatatcatgattattttgcaagacacattgtgcaaactcattactaaggaaatgatggttaaaaataggtatggtaattaatgataaaagtagaagtcacaacttactcccattgctattacagatgggtatggctggtggtgagtttagtggatagactttctacttaactcttagatggtgagtataactgatccctcaagtgtttgtcctcttacgtccaactctgcactatggaatacagggaaagtctcatgtgcattttgaaaacaagccaaacctgttatggttctgcaatgtacagacctgttgcatcatgcataccatttaaatttaacacctatatagatggaacttgtggctacacggaaaaatggagtgtttatgaatttgtgagcacgagactcttccatcaacacacagttggacgcattgggtttttaaagtagcttctttaaaaaagctgctccttggctcttggcagtttagagactggcctgtctgccaatttcatctttagctgaccacaaatattgcatatttttcaaagcattggagagggtggggggaggtggtcaacatagcagaaacataagttgcagtttgaattaaagcgtagttagtagataatgatgacaggtagaggaagaacggttggtgatgatttgtctctcagaagcacggttgggtgcactgctgtgctgggcagtgaaatcccaatttgatatcctgcaagaactgtaccctaacagtaggtggttaagtcactgagtgcagaatccacatttccatttgccttttgactgtgggaggaagaaaacaactaaaggcacactttggggagtgagttttattttctgattccttaattctattcagttattatcattatttttaactttttttcaataaaataaatccatggagctgtgaggctgtataatgttataaggaaacagaatatttctttggtaacctgtgatgattaaatgtgaatttatttgtgataagcttcctgaaggtttaatctgtctcccggcatcttacagcgaagtgctagagagaatcagagctctcatctgaagagaaaaatggaaaagcttacagacattacctctgtggcaacctgtcagaacaggagtgtttcttgacttttaaatactgttcttattcccttcttgcttatttattctgcacacccatgagatagagctttaagataggaagaaaactctgcctggagttttctatctgatggtttctccatttcttccatctttcaattatacagctataatattagcactgatacggtttgtgcaaacaataaatgaggcatgctttattcgtgcatgtataaataagtgaaggaaattggccaacctagactactagaatattccagtccttctctggccaccactccctaaattaatgttggttaatgttgttttaattagaattttatccttcatcttgatcttctttctgattaaatctgtttctagtgaaataaatgacaaagcaaactttgtaaaaatatcatttaaagttgtaaaaaatcaaatgaaacatccctaaatgcaagagaaggaaaatgatatatcttgattggtccaggtatttgtgatatccagcctgttccttcactatttgttgctttcgtccatgtgtgctcacaatgctgtgaaagtttggtaaggaattattgtaaagtgagaaccccagttcgtagagcattttttattatataacaataaatacaagaacctacagagcaggtgttagtgcctcgttttcagggctggatctccctttgagcacactcatcatggagaccaagtcatagtcaagaaacagctggtgaaaatacaggaagagcaagtcagataaatgagttgatccttatatcttggtaaccaatgctgacttatttatctttcttgatactgaaccagcagattaggctgccttctcatggagaatccactttcccaaattaaacggcacattcatcaaacatggagcccatgtttagtgtgaggttctgtatgatgtgtttatcatattattcttggcattgaatatgagagctgcaatatacctggtgtcatgtaattgatgaataaaggaaatatttggtgaacagagaaatttacttgagctggagggtgacttggtagagagaagaatcatggggattcttataggccaagctaaggggattgatcctgatcctacagcaacagggggagactaaagggttttatacagggcatgatacggattagcagcattgccataagacttcacaaaagaaaaacaagtatttgtagcggtcaaggcaagagaatctaacatccgtatgagtgaagatgaacagaagaaatatgtgtatatatatatatatatatatatatatatatatatatatatttctatagcttgggggtacaagttgtttttggttacatggataaattgtatggtggtaaagtctgagatttcagtttttctatgtggtttagctgctaaaaggaagagagatctggagtctgtagaacagaatgcaagatcaagtcgggaggtccatttttgtctttgttgcttttgacttgatgggaaattcttttggcatttaattaaaagtttagaaagaaaatggatggcatgtttctatgcctcagaggatttggttggccacattaaaagatgtgaacgatactttatataagtaaaagaataaccagggaaaagtaggttacagaggacatttcatgtaattgttgtaatactgcttccacagttataagatgagagaagacagcacttacagtaacacagactagcctggtgaagttttacaatattttcaagaaatccaagccattgattccctttcttagtggcactcatttaaaagctgagcctgttttaaaaaatatagataaacaactgctgaagtttcagaataatcacttcctaggggccctctccttgccatattccattatagcaatggagccccaacagacacgttagtgcccacacctgcctcggagagaaactaactcagatcaaataatcctagtcaattttgccgagcaaattcagctccagacaggcaagtctctgcagaggcacagcatggtccctcttccttatctttactcaggcaacagcgctcagaatattctctaccagttaacatgcagaatcatcttttttcttttttgtgccctacaggttgcttcttgtatttataaatgttgcatctgaagactctcttatgcaaaaaataaaggctgtttactcccctgtaggctaagtctgcaaagacagaactatcaaagggctcatctggagacacattctactagcaattaagagttgaggacagagttcaaagcagacgggtgtcagagccccataaaaacaccttgtactttctgctactttctttgaaaagttccccaggataatggctccatgtcatttgtaattttgataggcaatcctcctactccacgttctatctgacacatctcatgtattaaatatcaaaacagcaggccctagagataaagacattggagaatgccattttaaaaaccataaattttataacatcaagaggcttcaaaaaaaaaacaaaacctcttaaatcacacacgcacacagtccttaaaaatatgcttttccaatgcttaaacaagggctgatatgtacctagcaaaaccatggacaaatttctgtaaaagacatctctatgtggactctaaccctggtgggttcattttgaaatttaatatatgcggtgaagagctacaaataagatatgcttgttgactctgccaaatggaaagtggaactgatttctggaggtttgatcctaattctggtttttttggttgttgttgtttgtttgtttgttttccagggcagtatcagatagtttctatcgggggggccaagaaagaagtcattgcacaattctcaaagcccatcatttaaacatgagtcaatgatcatttttgcagggtgagaatttgggagattgttacggcagattgctcaaccaagtcaacacctcagcccattttcattctgtcatacatttcttgagaaggaaaaaacgtgtaattgaagtggagagatatattttacgtcaacccatttttactgtgagtttataatctgctagacaatttgtagcattatctcgcttcagcttttgtagaaatctattaacattttatttctttttaatcagttaataaatggaggtaggtatagaggcattcagaaaattagtcaaaggtgcaaagttacagcatgtgaagacatcaacataggcagcccaatatcttacccataagccaatgacattttgcatcagatgatttttttttgtggtaggggccgctctttgcattgtaggatgatttgcagcatttctggcctgcacaaactagatgccagtagcaatacctctccctccttaaagatgtgacaattggcatgtcttcagacagtgtcaagtgtcattgtgggggatgggggggtgggcaggggtgtagaaaataccccaggttgataatcattgcattggttcattcaagtagactaaaaacaaatgtagtagtttccaaagtatcctaccaagagagaaagcattgtcatccctggggaatttcctggtgccatgaattctctggctgcacctcagacacacaatatcagaatctctgggacagtgcccagtgatctgtgtttttttcaagccctctagatgctcctgatattctctcaagtttgggaacaactgtgttagaatcatattctatatagcactgcacactatcattttcaagggaagagagaagatgaaaaagaaaaagcaaaaagaaaatgagccaggcatcaggtcttaaacctgtaatcccagcagtttgggaggccaaaacaggagagctgcttgaggctaggagtttgaaaccagcctgggcaacatagcaagaccccatctcttaaaattaaaattaaaaaatagccagatgtggtgatgcaaggctgcagtcccacctacttgggaggttgaggcaggaggatttcttgaaccaaggagttggagaccacagtgagctgtgatcatgccactgcactacagcctgggtggcagagcaagaccctgtctctaaaaaacaaagaaagaaagaagagagagagagagagagaaagaaagaaaggaaagaaagaaagaaagagaaagaaagaaagaaagaaagaaagaaagaaagaaagaaagaagaaagaaagaaagaaaggaaagaaagaaagagaaagaaagaaagagaaagaaagaaagaagaaagaaagaagaaagaaagaaaggaaagaaagaaagaagaaagaaagaaagaaagaaagaaaggaaagaaagaagaaaggaagaaagagagaaggaaagaaagagagagaggaggaaagaaagaaagagaaaaaaatcaaatcagtccttaaaaatctccagagattgtttcagttacctgtagggaatatgtattaggtgaaatgaagactaaaataaagtctctgatttataactcagtgtgttttgggctccttatctataaactgcagttctaagttgcgtgacctgagacatgcagagaggcctggcttacattttagttgcctttgattgaaataagtaagaactctctgagtcatctggtttttcaagggaggtacaggactcactggctagaaaagcctgtgcaatttaatctcttgcacagctctcctttagataaatgactagactactgataaatgcaaaaaagaaatcatttccaaattggtccacaatgaagaggtgactaagtttgcctgatgggaggatgtatgagttttacgttgctgctataagaaattactgcaaacccattggcttaagaaacaacacacattgattctttcatagttctggagattggaagtctgagatgagtcttagggggctaaattcaaggagttggtatggctggttctttatgaagattccagggagaatccattccctgacttttccaaattctggagtcttccttgactcatggtctcttcctttaccttcaaagcacatcattccatctctgcttctgtcaccaaatctcctctcttctttgacattcttgtctatgtcttataaggatccatgtgataaaagtgagaccacttggataattgaagatgacctgtcatcttgacacccttaacttgaccagatctgtgaaggcttttgtcatgtaggtgaacatattcagatcccagaagtcaagaagtggatgtctttgagggacaaatgatccaatctatcacagaaagtcagttttcatccctttcctagaagtcaccatgagttcaagcccagcacctgcagtttcctctggagttcactgttgatccaagctaggcatgatgcattttgctcctaagtcacgatgcattctactgcatctttcaggaaagttagatgtgccatcctatggaataagtatatcatgctgtctttctggccaccacagtcataaataaatgacagacaggggctaggaagaagaaaggaaggagttgcttgctttatggtcataaaggcatgtaagtgatgcattccaaggatgtggcaatgattataatcaaaggcatagacgtgagagcctccaccctaatcgtagttaggctatttcctatcccaagcaaagtgctgtaatcttcctggactttaattccctcacaagtaagacagggataagagtcacttcaggatgccattgtagtgatttaatgaactaatgaatgaaaaaactttaacaagttgtctgcaaccttgtaggcactcaaggaatgataataacattttttgaggaatttaaatgccaccaccagctgccatgtctttgctgtttattattcacaatttattattagcacactgttttcaagtgccttctaagtagtaggtctctgcaataaaaacagtagcaagatttggtgactgaacaccacagctaaattcctaatttaaaaaatcagagtagatttaattaggaaatattcatgcaccagtcatgttccatgggcttgtaattgaactgggagtaaaggaagatatgtaaactgtcttcctgtatcgattgcatgtctccaacagccgagctcacaaagggctttcttcttggaattacatttgtcatagggggatttggagctcatactgtgcaaagggtgcaaccagcctccatttcatcctacagaccacacctacttcaagggcaacattttatacaccctaggtggagagggaattactttaaaataaaacttacatatttccatgcaaaaaagaaatgcaacttcacataaaaaatctgtaaaattgccattatggggaagaaaatagatttttttctgtattccttcactattttatttatttattttttaattaattaattaattatttttgagatggcatctcactctgttgtccaggctggagtgcagtggcacgatctcagctcactgcaacctccgcctccagggttcaagcaattctcctgtctcagcctcctgagtagctgggactagaggcactcgccaccacacccggctaatttgacggggtttcgccatattggtcaggctggtctcgaattcctgacctcaggtgatccacccgccttggactctcaaagggctggggttataggcatgagccaccatgcctggcctcagtatttctttactaaaccaacactgctctattagtttacactttttattatatttatcattagcgttgtttatctcatactttgcataatgcagatgatagaagccctctatgaaaaaaggcataaagaggaacttagtgatggtaaaaatctcccagtagtcattttattatttatccttctcgtcaacttctccaattatgaaggacactattataacataaattatccaatgaaaaaattatgacttcactttcttatgaatagtgaggcattcctcattttaagaaatacggattaagcacatacaagtgcccagactgttttagatgtcaggaacaggaataagcaacttgttagttagttttaaagggtaattggaatactgaagcattcagtccattttttggcttccttagtaaatgttgatgtattgtttctaatataagctcctttagagacttgttactgtttctgcagaaacaaagcaaagcaaaaccaaaccaaaccaaacaaaaacaatcaatggacaatgagatctcttttttaattttttttcatttttataatttccctttatattcaaggagaaagagaacttcaatttgtttatttgttattgtcattattgccttatgtatcggaaaggtaaaccatatgatatttaaaaaaaatctttaattcctcacatgaattgctaacaggactccttttgtttctacctacacaaagacatttttgctttcttttaaacttgtgggaaatttacattcctgaggcagtacctcactgctaatcctgggctgttggaatattagcatattactacaatgaaatatactctggtcaaaaaggaatcaaccagggctcagcccaaattataggtgaaactttgtagtagattaaggcaataaaatattacattgcaatcaaaataaatcagccaggagatagcataaaacatacatgaaactttgcaacatattaaacaagttcaaacatattacaaacaacgtaatatgctttaagtttaaaacttagattaaaaaatatatatttttaaataatatatacatatcccagcactttgagaggctgaggcaggtggatctcttgagcccaggagtttgagaccagcctgggcacatggcgaaccccatctctacaaaaatatatgaaatttagccagggatggtgatgtgcacctatagtcccagcaacgctgggtggctgaggtggggagatcacttgagcctggcgaggttgaggctgcagtgagccttgatcatgccactgcactgcagcctgggagacagagcaagaccctgtctaaaaaaaagaatatatgcataaactttatcaaaattaaagcaaccacaaatttaacaaccacaaatttagggggggtccttgctttaagccaagaaggcagagaaatgaaatgaaggggaaaccacaagtagttataacatattgtcgaggtgacatttttgtgaacgtgaggtataagtagaagaaagtaaaggaagataaaggagagatgaaccaagaaaggagaaaagagaaaaggagagaagggagggagggaaggacgggggaaggaaggaaagaaggagggagggaggaagggaaggagaaagggaggcgggaaagaagaagagggaatgatttatgtactacaaatgagaataagtcataaagcaagaattattattaaatcatttccatataatgagttgaaagtaagagggtgaggagtactacaatgattaaaaccactaagtgatggagatctggttctgagagacaagatcacaccatgttgtataattctccagttggctagaaatttgagaagcatggctctgtccagaaattcattacagtccacggattggaaatgtcatagcaaaagaaaaattgtctaaagaaggagtgggtttggatcaaaatgttttaaccacttagcttgtgtgtgtgtgtgtgtgtgtgtgtgtgtgtgcaagtttctctcatgtgcccattttatttctgctgatgcatattattttattgcattgacattatatttatacactggtaaaaatcaaaggatggtatatttattatttttgtctgacttctaaattcaattaatggcaactgtgcatatgtttcatatttttgaacttttcacattacaattgaactcgttaaatatatagaaatatttaaatttgtgtcttaatttctgtgcttataacctttccaattaaacctgaacattttctaaatttgtattatttgatgcatccactacacatattgatgaaatataatttaaatataaagtggcttttaaatttttatttttattttatggtcctttcactgctaaaaaaaaattttacatcaatgccatcatgaaattttgggggaacaaatattgaaagtaatttctctttggatgcatgttttaaatgttgagatcccaaataatgcaaatctgaatattttaaacagccccatgcgagtcctcacattctattttgagaaatctgatagacaagctggtaattacattggacaccggctttcaatcaactcaggctgcaagctgtgcttcaatgattctccaagcagcatgataattaatcatcgacttcaatataagataataccctcaaagccccaggagacagctaagtatacatcaacctcttccagggatgggctcctcactttgagagcataaacctgtaattgttatcttctcgaagtttacaagtgtgccctgtcaaaggcctcccccaaagcaacatttgatttctccttggaggagactcagattaattactgttcatcgccaccccaatgagtcatatccctaacctgtaggaagaatccatcagtggaattgtagttacacattccactgaagccacactcaatttgtgtagaccaggtttggcccttatcttatcacaatctatctggcataaagatattatttaaagttattcttaatgtggtgatgatgacagagaaaaaaatatacaactgataatagccccaaggtctatgctgtgaggaacaaggggattctgagaatggggtgtctggaacaactgacatgcatcttcattaaacaatcattataatcacaggtttgaaggtgtccatgcctgagctccagttaactaattgctgtcatttgctaagtgctttcgttggctgagttcagaggacagatgctcccccacctgggacaaaaacaggctaatttgcaaaatccctttttaatagcacatttctctgtatgtctgtagttatctgtttctttatcagaaccccaacatgcaagtgtaggtcctagagagaaagatgagagagaacaccctgatttaaagtattttcaaatataacagtctatcaaatagaggagatttggaaagcaaatttcattatgaaaccccacattcggaaaagaatcacaaacacagagacacaggtttgcaaaccaatatcaaagtcaggactgtattccaacaagtaatctctgacaagtatgaatttgcaagcttgtgcctcatccctctcccagaatataattctgtcaatttgtctgtgtagccttgggtgtcacctacatctacctcatccatcgaataataattttcttccccaaagtacctattatttgtcaggctttgtggtgagcagtttatatttgccacacacctggaaatgaagattgaaagaagtagtgatgtcattttcaccatcttgacctccacaccacccagtgagggggagatgataacaggtatcatgcatagcccataaatgagcaagatatgtgtagcttctggataggtatggaagggaggaagggagggaaggaggagaaagaaaaaaggagggaggaaaagaaacagagagagagagagaatgagggaggcagaaagagggaggaaagaagagaagaagagacagatgaagaaaggaaggaggaaaaaagaaaggatggataaaagaaaacagaaggaagggaaagagaaaacgtgggaggaaaggagggatgaaagaaaggaaggagggaggggaaaatgaggaaggaaggaaggaagagagggagggaggggagggggaggaggagaagaaggagaagaaggaggaggaggagggaaggaggaggaggaaagaggaaagaaagaaagaaagaaagaaagaaagaaagaaagaaagaaagaaagaaagaaagaaagagaaagagggagggagggagggaggaagggaggaaagagggaagaaggaaggaagtcaaaaggaaggaatgtcaaaagaaaatggaaggaaggaaagaaggaagttaaggggagggaagagagaggatggggaggatgaagagaggccatagggaagagagatatttttatattaccaaaggctcaccttgattgtaaaactgagccaagatgggaattttggtttcttgtctgccatcagtatggtgtccccaaagaaacaaagaaattgataacaacagacatacagagaaatgtgctattaaaaagggattttgcaaattggcctggtttggtttggggtgggggagcatctgttctctgaactcaggtaacaaaagcacttagtaaatgacagcaattagataacggaagttcaggcatggacaccttcaaacctgtgattataatgattgtttaatgaagagccaagagagagccactctggcattctaaaaggaaaatgagatactcaaaatgacaaaccagagtgataatctattaatgcgttgactttctcaggaagaggaatcaagtgatgcagtgaatggcacagacaatcctcacagtggaatgagctatagttggctacacatttgaaggactaatggaaaaataaagtaaaatggaaggcggagaggtggatgctctagttctaacccctctctgtgactaagtagcttagtgtcttgcagattccagtacttcctttaacatttagtaggtcaacgcatgcatttaggagatcttacacaactgtgagatgcaagtaaataattacgtctcatggtccttgtaatgtagtcttactcctagaattccttattccccaccttgtcttcactgtaatttgctacagatgacacagattcacacacacatacatgcatggtgacattattaccttttttttttttttgagatggcgtctcactctgttgcccagtcttgagtgcagtggcacgatctcagctcacagcaacctcggcctcccaggttcaagcaattcccctgtctcagcctcccgagtagctgggactacaggcacttgccaccacacccggttaatttttgtatttttagtagagatggggtttcgcca[134 bp omitted]gtcccttgatttaacattattccacgcagggtatggtggctcacacctataatctcaggaatttgggagactgatgtgggaggatcttttgagcccggtagtttgagaccagcctgggcagcatagtgagacctcatctgtgcgaaacattaaaaagattagccaggtgtggtgtcatctgcttgtagttccagctactcacgaggttgagatgagaaaatcacttgagcccaggtggtggaggctgcagtgagccgagatcgtgccactgcactccagcctgggtgacagagtgatactccatctcaaaaaaaaaaaaaagaaaaaaaaaaaaaaaagttaagcacagaattagcacctgactcagcagcttcacacctaggtatatactttcacaaatggacaacagggatgcgaacagatgaaaacattattcacaatagtcaaaagatagaaacaatccaaatgtccatcaaccaatacatgaacaaacaaaatggagtctagccacacaatggaatacattattcagccataaaaattaaagaagctgactcatgccatgttcttctacaacatggaagatctttgaagatattatgctcagtgaagggaaccagacaagaaggaacacatattgtatgatttggctgatatgaaatatctagagaaggcaaattcacagggacagaaaggagattggtggttactaggggctgaaggagggagagaggaaatggaaagttgttgcataatggtatagattttctctttggagtaagaaaatattttggatatagatagaggtgatatttgcaaaacattgtgaatatatttagtactacagaattgcacactttggttaaaatggcaagtttcacattatgtgtgttttaccaccataaaaaatagtggaagaaagttagcccggccctatttaattttagcaaagaagaaaaccctaaaagtcctgacttgaccaccacacaacctatgcatgtaacaaaattgcacttctatttcataaatttgtataaatatataaataaatattctcaaaagaaagtttattagcaaatgtctgtatctccagccacccccaaaatacacatgctaaaactgtttcatgagaattcctgggaaaataatgaagcagttttactaaaatctatcgctctcacaaaatctttaatctttgttgaagtttttctttcttgttttttcttaatttttagctgaacacgaataagtacgtggaaccatctgttgcttgaatgaccaactcttgtctctggtacaatcctttgtaaaattctcaattgtgtaatttagtgtggaagcaaaatatcactagctaggcttacaatcgttgtgctagttttcaacttaatttcatgccacaccaaaggacttgagtaaaaagttcatgtaatagtctaactatgttttaggatgtctttttgcaaatgccctgcaaaaagtaaaaacagaaattttaaaaaaggccgggcacggtggctcacacctctaatcccaacactttgggaggccaaggcgggcaggtcacttgaggccaggaattcaagagcagcctggacaacatggtgaaactccgtctctactaaaaatacaaaaattagccaggcatggtggtgcatgcctgtaatcccagctacttgggaggctgaggcaggagaattgcttgaacgcaggaggtgaaggttgcagtgagccaagatcgcaccactgcactccagcctgggcaacagagcaagactctgtctccagatgaataaataaagaaggaaatagggctttggtgtcctaagaaaaagaacaaataattaaataaaggtgttaatatgatgagaaagggttactaatgtaaaactaaagacatctacagaaagtatataaacgctccttttttctctatgtttcagttacatttttttctctaacaataatttgaagtcatagagtggattcaagataacctgaatttttgtgccttgtccaactctaaaccttgggagacttttaccaagctatttaatgcttttctaggtttcaatgacatcgctgaaaagagagtgaatgataattgttcaacctatttcacagagagttgttgggaaggtcaaaaatgagcatttcattataggtattttataaactataaactagcatgaaatggaaaatgttcacagttaacagcataaaattcaacccagaggacaaagagtttaaaaattgaagaatgaaatttctgggagaaaatgtgtccctgacataaaggtgacatattctcaggactcaaacatgttcaggggtgggaagaacagttgctgatgccaagaacattttaccctcatgacaagctcgggacctcctcagaactatccacagcattggtcttccctgcgtgtgtcagctctgctaaaagcaggagagagtgtcggctctagtaaaaacagagctatggtgcgaggcttatgaaacctcttgcctggaagccactccaccaagcatgtccaatcttttggcttccctgggccacgttggaagaaaaactggggccacacataaaatacactaacactcatgatagctgctgagttttgttaaaaatgcaaaaacatctcataatgtttcgagaaagtttgcaaatccgtgttgggccatattcaaagctgtcctgggctgcatgcagaccgcaggccatgggttggacaagcttgacctacaccattccatattcttaaggcagaagaaaactcaactgccagtgatgaccaaatataatgaggaagaacgtaggcttttatctgttgaattctgttccccccaaaaagatatgttggcatcttaaccccttggaccccagaatgtaccctttcttagagacagggtccttgcagacataaatagttaagatgaagtcatactgaagtagggtgagacctcaatccaatatgagtggtatcctaagaaaatgtggcatgtatacaccatggaatactactcatccatgaaaaggactgaactaatggcattcacagcaacctggaaggagttggagaccattattctaagtgaagtaactcaggaatggaaaaccaaacatcctatgttttcactcacaagtgggagctaagctatgagaatgcaaaggcataagaatgacacaatggactttggggactcggggaaagggtgggaggggagtgagggataaaagaccacatattggatacagtggacactgctcaggtgatagatgcaccaaaatctcagaaatcaccactgaagaacttactcatgtgactaaacaccacctgttccccaagatgagtggtatccttataacaagagaagagacaaagagacagacacatacaaaaagaagatcatgtgaagacagaggcagagattggagtgacacagccacaagcaaagaaactccaaagattgctggccacctacagaagctaagagagaggcaatgaaacagatcatcccctagagccgtcagagaaagcatgaccctgtccacaccttgattccggaattctgacctgagaactgtgagaggatacatgcctgctgttttaaatcacctggtatgtggtatttcttagttcagctctgagaacaaatatgagatattcactttttattgtaggttactcggagatacagtaactaattctcatctagaaatcgcaggtctgtattgcgagaaagagagactgcactttccgcaaaaggtagtcatgactccatgagcaccttgcagcagcacctggtccagatgaaattcccattcggtcttggctcctttgaagatattgatgacattatggtaagtaaaggacgccagacacaacacaacaaatattatgattccactgctatgcaatatctagaatgggcaaattcacacagacagaaagtagaatggtggttaccagaagctggtgcagtggagggtgagaaatgagaacttattgtttgcactcttatgagtgcaaagattcagctttgcaaggtgaaaagagttctggggatagatagtggtgatggttgcacaatatgaatgtactgtagttaataccaccaaactctcaaaaatggctaaagtgggctgggcgtagtggctcaagcctgtaatcccaggactttgggaggccgaggcgagtcggatcactggaggccaggaattcgagaccagcctgaacaacatggtgaaaccgcatctctgctaaatatagaaaaattagccaggcgtggtggtgcatgcctgtaattccagttacttgggaggctgagaatgacaattgcttaatcctgggaggcagaggctgcagtgagccaagattgcgccactgcactccagcctgggtgagagagtgagactctgtctcaaaaaagaaaaaaagaaaagaaaagaaaccaccaccaccaccaccaacaacaacaacaacaaaatgctaaaatggtaaattttattttaggtatattttaccataattaaaaagtactatgttattttaaaaattaaggctaacttggaaaagtaaagattatagtctcttgatctgtagtaacagtgtcttgaaaggcattcttggggactctggagccaggcaccttcctctttgcttttttgagacagggtcttacccctatcacccaggctctaccacagctcactgcaaccttgacttcgtaggcttagatgattctcctacctcagcaactccatcttaaataggggctgggtaaaatgcagctaagacctgctgggctgcattccctgaaggtctggcattcttaatcacaggatgagataggaggtcagctcaagatacaggtcacaaagaccttgctgataaaacaggatgcggtaaagaagcaggccaaaaccaagatggccacgaaagtgacctctggccatcctcactgctcatataggctaattatcctgcgttagcatgctaaaagacacttgcaccagcgctgtgacagtttacaaatgccagggcaatgtcaggaagttcccctatactatatggtgtaaaaagggaaggaactctcagttcctggaactgcctacccctttcctggaaaactcatgaataatccacccctcattgagcatataatcaggaaataaccataagtgtatccagttgagcagcccacaccactgctctgcctatggagtagcaattctttattcctttactttcttaataaacttgctttcactttactctatggactcacctggaattctttcttgtgtgaagtccaaaacccctctcttggggtctggattgggacccctttcttgtaacaaaatcatctcatccaaagcttgtaggttaggggcttttcaaagacagtttaagggaaggggtcggggtagcaggtaacaggtgcttgctgccgattgattaaggcaatgatgaaatcttagggggttgaagctgtcctcctgaaggctgaattgcttctgggtggggccacaggagggggggttgctgggtccaggtggagccatgggtatcagacatgcaaaaagactgaaaagttatctcaaaaggccaatcttaggttccacaatagtgatgttatttacaagagtacttggggaagttgcacatcttataacctctggaataacagctggcaatccttcatgtctgtgccttagcaggaatcaggctgtcctcctccctgcagcccgatggcctcccatcagctttacaactgtggttgggtttctgggcaaggcctattatcatttaaactgtagcctaaatgtcttcccaagttcgcttggcccaatagcgcaggaataattaagagaaaggcaagatgaggggtgggttagctcagcttactgttataatttttatcactgatgattgaatttttgcaaactcgatttttctcactgatagaatttttgcaaacacacacttgccaactcacatatactcacatgaacacactgacacacaaacatgctcacacacacctgcacacaaacacaccatgcacagagtattttgctacaacttattttgctcttagactgattcgttttttcctgctttagggaaagactgcttttaaagctgaccgtgaaatacaagggaatgtgctcctccctgaatttcttttctctttctaaaaattaactacatgtaagcttaattttacaattctaaagagagagacacatgtttgagaacctagtataaacaaaacgtggtacatagaaacaaacaaacaaataaaaatcctagtatgtatttcagcatgtgctttgaaatcctttgacaaaattgcagaatccttttaggggctgaaacattgacgtaattcacaaaccactgcagtagccgtctctaattctctcacaattactgttaacacactgggtgaatacaaattagcagatgagaaagataccatgaaaacgtttaaattaaacttggccctggcgcttcctgtaggggatgctcctgcactccctagaattaccaagaagattcaaacaaaaatatgtgaagagttggggaaataggatagcatttctgcccttggtgattcaggtgacaacaattagaagcatgattaaggatgctatctagatttttatggcatatatctatacaaggctttgaagttaatagtgttttaaaggatattctcggcttttctgtttttgttcctgaagcctttttttttttttttttgttaggaaaccataagttaaatatggtatcacattgataattataatgtcggcttaattttaaatcgtccccacagttgccttctggcatgtatagttttgtgtgctaacaaacattctaggccactaataatgaactaactaggtaaaaatggaattatttctttagaattggaaataaaagaaggaaacgtaaaaatgcagaataaataggaaggctgtaaattgaaatataaatttaggatatggaaggggaacaggaacactcagtgcattaatatgcatctatgaatttgaaaattcttctctaatgaggtaagcattctgtgaacttacttgatggggataattttgcatcattgacatgatctcctttgtactattcagttcttgctttccaactacctagaattttttgaaatattataaattttatggaccaaggtatgctgccattgcaattcaatctgagatttttttgcttattgtattataagcattgctaaatcgtattgtgtatgtatatatacaagcacacatacaaaatacaataagccaaatatatgtgtgtgtatatgtgtgtatatataatatacatatatgatataaatatatgcatatagaggtatacacatatttgtcatatatttacatatgtaaactcatgagtatatgcacaagtaaatgatgcttatataatgttacatagttcttagctatgataaaggtaactagatgacaactttctttcttttctttttcttttttttttttttgagacagaatctcgctctgctgtccaggctggagtgcagtggcacgatctctgctcactgcaacctctgcctcctgtgttcaagcgattctgctgcctcagattcccgagtagctggggctaaaggagtgtgccac[187 bp omitted]ctactgacagactagaaccaaaaaattatttgcatttctacaattctttatatggagtacctgtccactctaggaaaaaatggtgggtttttcttaaccaataaagaaaccatgaatatgacagtacacttgttgagctgaggttgcatgcagacatggatatttgacattggatggaatttgggttgaatcaaaatctcagtgagatgttggaatatgctatagtttggaaggaaccctacccaagaggtaattgcccggcaaggtgtcagagccctaacattggaaagtggtcagctctcagacagtagggtaggaaatacaatttacagacaacagtatgggtttaaaaaagaaagttttattggatagaaagaatgctgcagaagagtgcagtgggtgcctcagcaagagaggactgagctcgccgtggtggattttccttatccgtatttaaggaccttaaagcaggagctgaagggtaatttgcaccatagtagccatgtaggtcatgataaatgatgacatttgtagacattttggtgccttaatgtcagcaagggttgcacaatgagttttgacatgcatgcattctagagtaaccagaaattctagttacttataattttgggggaaaagaagcctgataccctataccagctttagagaatagaggagtctaattatttctgaattcctcagataaggagtctggcctctggatggtctgcttgatggccaccaggtgatctttggtctcctcagtaataattaagctagtcattttaggtaaggtgccctgggaaacagtgtggggaggaaacagggggaagtgagggatgtagctggaggaacactagcataaagggaagatgaagatctcggcaaagaagaaatgataggtcagaaagagcacaacacagcagccttacttggaggcagtagacaaaaattctactctacaaagtcatggttaggggaaaagaaagggaaaaaagagttgggtttggcaatcttacttatatgcttgcaaattcaacgatgttgacagttcctatgttattttcatttgaactagcatttctctaattaatacagaatgtgaacaacattttggtatattgtttactccaagctttctagtattgctttggctaccctatttcatttttattcccttatattattttctttttcctgcttatttttggtttaacttgcttttcctcttctggtttcttgaagtgaaagccagggctccttgatttaaaatcttcattctcttttgatatagtcattcagagccataaatttcttagtacaggtttagtgttatcctgcaaatgtcatacattgtggttccatattcattttgttcaaattactttctgatttctgattttttttctttgactcttccattgataatttacaactgtgctattcagtttctaatatttggacattttctggacatgttttaattattgtttgtaatttaatgctattgtggtcagagaacatacattgtgtcatttggattttcttctaattttttgagatgtatgatatggtgtggctctgtatccccacccaaatctcacctggaattgtaatctccacatgtcgagggaaggacctggtgggaggtgattgaatcatggggacggtttcccaaatgctgttcccatgatagtgaggcagttctcatgagatgtaatggtttaaaaggggcagtttcccctgcgcatactgtctctctcctgccaccttgtgaagaaggtgtcctgcttccccttccgccatgactgtgagtttcctgaggcctcctcagccatgtggaactgtgagtcaattaaacttctttccttataaatcacctagtctcaagtattcttcatagcggtatgaaaatggactaatacaatgtattttcaggtctagaatgtagtctatcctggtagacatgcctgtgtctatttgatcacgtatgcatcttagaagttaactcaagaatacttacaggatacaaaaatattcaactccaaatgggtaaattttacaaggtatggcatccaaagaaaaacttctaattatgggaaacggtataaaaatgtaataaataagatgaagaaaaaatcaatcaatcaaaatggtcccagaaatgacacagatgttagattatgcaataacattaagcagttattataactgtatttcatgtgttcataaagttagataaagacatcacagatacataaaaggcccaaatcaaacatctggatataaaatctacaatgtgtgagatcaaaattgcattgagcagaattaacaggagattagaatttgcaggaaaaatatgacttatgaatttaaagacatagcaataaaaaccctaccccccaaaaaaacagagaagagagattttaaaaagtgaatagaagatctacgagttgtgggaaaattttaagtaccttaatatacatgtaattggaattcctgaaaaagagaaatcacagaaaccatatttgaagacataatgacaaaacattttcatattcgatgtaaattataatcccatagattcaagaagctcagccaactcaaagcaccaaaatcacaaataaaactccaacttataaaatttgtagatgatgccaaagaagtatttaggagaaatgcatagtactccataatcagagtgctgaaaagtgatgattcaaagaaaatcttacaagcatccagagagaaaagacaggttacataccacatgtcaaagtaatgattacagcaaatttcatgtgaaaaataatgcccacaagaagacggtggaatgatctaatgaactggagaggggtgggagtgtaaggtaatctagaatcaaacaactagcaaaaacattctttaaaatcagagaagatgtagacatgttcaaaaatacaaaagcagaaagaattgaatagcacagaccacactgcaagaagtggtaagggcatccttcaaacagaaggaaaatgatatcaggtgtggctatggaaatgtggatttatacaaagaaatgaagaacactagaatttgtgactgcattaataatgtgttggatcttttgcttatttaaatctctttaaaagatattgattgtttaaacaaatatgacaacaatgcagacatcataagtaagtgcatacatgtttttcttgttactaatctccataaaggataattgatcctttaagcaaatatgatctgatctggagtttataacatatgtaaatgtaaaattaatgacattagcacaaagctcaggaagagagaaatgcaagtgtattctggtaatcttcttattagataagtatactccagtaatgtgaagtgtgacatcactggaaaatagataggctatgatgagttaattatgtgtactatgaaccctaaagcaaccaccactataacaatacaaagagttacaactaacaaacttaaaaacagacaaaatagaattataaaattaattcaattggtagaaaagaacacaaatagaaaaagagattaaaaaaatgggacaaataaatggaaaccaaataggagatggtatttcaaagtttgccatataaataataatctaaaatgtaaatgctctgaaaacaccaataaaaaacagtttttcaagttgaataaaaggcaggacccaatgtatgctgcctaaaagaaacacaatttaaatataaagacccagggtgattaaaggcaaaatgatagaaaaagttatatcatgctagtcctaatcaaataaaatttggtgtggctatattaatatagcaaaaaggatgttttacaatgaagaatatcctcagtaataggggttatttcttaacaataaaagggtcagtttaacaagagaacataaaatcctaaacttttatgcacctaataacagagcctgaaaatgcacaaatcaaaaatttatagatgtactaggacaaccagagaaattcacaacttaagtggaaattttaaatagccttacatgaataattgacagaaaaagcagatagagaaatcagtaaggaaaaaagaggttagattaacactatcaatcaacttgactttaattaatattgagagaaaagtcaacccaataatagttctttacaagacaacagaaaacatttagcctgttagaccatagtctagatcataaaactttttataataaatttaaaagaattcaggtcatatgtataacaatttatttttaataatgaagaggtttctggaagctaatggaataataaaactcattatttaaatttttataaaaggtacttggctagctgttattgttttcatacttaattttacatttctaattctcatcattttttaaaaaattaaaaattagagttatttattaaataatgttagggtgctttatttttgtcttttatgtaataaatataaattactactgcagaataaaaattagatgaaatgcatgggaacagattattttaccctagaattccattcctaaagaaatctaaagacttttttatttttatttttttttgttcttaagatacaacatctcaagggatttcatttttaatttcaggcataacaacaagttctctaggcctgataaatgtcagacttcaaagtaccctgaattggagctgagcttgagtagtaaggaaaactgatttgagcttgggggcagagaattgtatattaacaaatcagaggaatatcttacaaattctgatacgaagaagaaagtgaatgagagcagggaagcaaggtctggaatagtctaggtagcagaataatccccctttgccccaccttgtcagggtgcaagatgtcaaccattttggggcttttataatgtgtcatagatggagaaacctgtagtcttcagaaatgatcttataggagaaggccattgctgtatagctgtcttattaatctcttatcacatgagatttggtagccaagacaatatccacgtttatgagctcgaccaagatcaagctcaaaatgaaagaactgaagacatcagtaggaattaattgtgttagagactggatattataggaaagtagacataattcatcttaactgctagtgtttgggttaaagatgcaaataaaattgaactcagaagacatctgtttttttaaaaactgtcaatatgaaataatggtactaactagatcactcccattgtatgctacatgggaaagctacaacttttctacctaagaccaatctaacattatctctaaaatataattctacacctttttttattgccacctggtcaaactgttattgcctccttaatatagacattaggaaaggaatgagcattgtgtttacatgcgtagagttaccactgatctatgaggcttttatagataccttaactccagatctccagatagacagagagagagagacagcgataataaatataatatataaatataaaatagatataatatataacatatataaaataaattatagattttatgtggatatgaatatataatacatattttcctaaatttttacatatataatatatgaatatatttttatatattatttacgttatttgtataaaaatatttgtatattatatattttataaaattcataaacacatgttcctatatttaaatattaaaatataaatacatatgtaaatatatatatttttatatatatattttttcatctaacgtcctttaggttttcgttgcataggttgatgaaaaaaccttaagattatatatgtcaaacaaagtagcaattaaacagtattttgccttagattatagctaaacaatttcttttagttccttttttctttttttaaatttcagtttgaaatagttgccattaagcttcgcaagaactgcaatcactttgcctgtcaggctgttagcactttgttgcaactgatataaatgatgtggccagacaatttgcagaagtcaggcaattaatcagagaactgaaaacatttttactaaaaaagtcaagtaattgaagcatatctaagaagctgtaacttacctattgattcctcagaaaatttctggatattcaataagtatgtcacatatattccctcaagtttaaaacaactgagtaatttctatctggatattttagtactgagtcataatctggtggttacacccctcaaaattttcctcctgcctttccttttcccaaagggaagattaaaaatagggatgaattcaaaatagaaagaattacattttcttttgaaaacaaaataaactaacatcttttacggagggtccacggttttccttgagggagaaataaaaatctgagtttgcatttcaactgatacaaaaatatatgagttctcatatgaagactaaatgcatatgggtttattgatttttcctttacattagaaatagcacatttgagaaaagaacattttaggaggctttcttagagtaaataaataagtcagattgaagagaggcttttacaaactcttaaatgccattgttcttcttaaaaattatccagagtttatggaaaagcagaatgaccccaaagggtgggtaagaacatttttgagagtgtgctcatagacacctgttgccagaagtagatgagattgggtaccttcctaagtacagggagtgtgtccaagtaccacaaggcacattgaactgcacctgcaccttctgggtcgttacctgttctgtgatcaaggagcaactaggggtcatttgacttggcttgaagcagagagtcatagcagggcttccttggttgccacagccttgtccttttttttggatgtctttctccagggtttaaacctgataccttcttaaaggaggcactgcagagagaaagcaaaagtcctgccattagtgatagtgcttaaatcactgaaaccaaatctgcagcattaagcgatcttgaaaaatattatatccataaaatattctaggaagggcccagctacatgattaggctattttaccaggtcatttaacacatgtctatttgagatttgtatttggtgcttctgtatttaatgatggtcaggaaagcaaagaccaaggacccagaaaatggagagtttgagggcagaatagtaagaaatgtttttgcctttaatttcagttacagaagatatatttataaagtcactgaattgtaaattagcttcccataaacatgttctgaatgaccagttagtggaataggacttgtctatttgcccttctgtatgtaaatggttttaaatgtctccaaataccaccaccattcttgttatgttcaaatcctatggccaggatgggccctttttatgagatttttttttcctctgataatcaagaaattgttattaagcagatttcctcttgctaattatatagttgtcagtttctcttcattcataacattttcaatcgtaaaattaatagtgtgtcttcacctgttaataaaatagaacccatcagtagtgagtaattctgttttttccttttctgtgtttggttgcctgcctccatgaacagccacataaagtgttgtgttttgctttaataaataagcagcgttgtgatgtaggcaatgtgatgttttggctgttggctgactggaacatttgcatttataggctgtagacaaaggccaccatgttttgtgttcatgactcataaatgacagcagggtcagggaaggacttgtctgctgtggtggggcaggcattgccctggggtctgagctttgctagcgtgcacagggacaggctatgctgggtgggcagcagagtaaagcagccagaatcaaggacccgctggacatcaaagccccatgtagacagcagggtcactgcagaaatgtatcagcgggatgaggggaggaaacagggatgagtcaggcttgctgcttcctagaggagcaaaaagagctcctgtctaggagtcaacttgcactcatctaggattccatcttaattgtgaacctcaggaagccctgccttgtggtccatccatgtcactgtcaccatgcctgaatatttcctaggcacgattggtttagcctcgactgcaataccctgcaacatgaccctatacctcaactgctatgagcagcccaaggagaaaaaccctagtctttactcttttgtgtgtcctctttatcacttggcacaatcacagtaaatgattaatgtagcattttagagaaacgggttttgggaaggcaggtgcacatttgtggaggcaatacaagtatgcagagaccagagttgggactgagagggtcttgcacatgaaaatgatgaggaatatacgtctatgtcagaaaagtggtgggagggcagataatgtcaaatttaaacagaagagcaacaaaactaagcttccttttaggtcatgttggtggtgcctccttctagattccatctgtgatgtttcatggtcatgttggacaccattttgggaagatcatggattacacctatgagaatcttatctttgttctgcaagtttccagcaggaaaacattgggttggactcaagatatagcttgggtgaggttgaaggagcaaattgaagatggatctttgtccttccataatgtgactgtgtggccaaattgacaggatgtgctaggactgtgggtagagcatatgtgtacaaacacatcataatatctggaggaggctttcatatctctttgaaatttgtcaagatcaacggaaggggatttcaaattccatggggaaccgatatggcagagaacattcatttgcgtgagtagatttaggtaaaactactttgaaaaattcaatccaacacatttatatttttaaagcactattttaagtacaataaaaatgaaatacaatgaatgatttctccagtgaaagaaatcatttcactggggccactcagtacttatctgtttatttttaatttttattttttgttgacatgcggtctctctatgttgtccaggctggtctcaaactcttgagcttgagtgatcctctattatttatttttatttttatcattcttttagagacaggatcttgccctgtcacccaggctggagtgcagtggtacaatcataggtcactgcgacctcaaattcctgggttcaagtgattttcctcctgcctcaccagccagtattttaaacagagaccttatatgtggagattttcaactctaaaatcacagggtcctgctgagaggttcaaagtgcatgctggaactagcaagaaccaaaattaaattggaatttaaaagaaactgctcctagtacaaaatctggtatctgagtcatttccacgccctatattttttgttataggtcaaataataatgatctagtataggtcggaaaatattataataatttacacacaggttcatattatacactagcaaataattatttggaattgatctagtggtcactaatctttgcttctatttaatcataaaaatatgaacagtaaatttactcatgatttttttttcttctgtggtaattatccatttctttcacattacttgctttaagatgttcagattctacccttcttccctgaagaacttcatggtttttctggctttagatttgaaaagtcagagaatgaataaaaaaaaataaaaggttaaaataatataagctcttcctaaggcccccagccaattagacatgcagtccctggaaaataaaaaggacaagtcagccagaggacgtttgtttttgtatgcaagtctgtaaagtgatcactttaatttttagggctacccgaccgtgtctatccataacaaatgaactaaaatgcttgcagtgtgcgcattttttccccaaaatcactttcatagattgagcaatttggagcatttaggcataccttttgtttcttttgccttgttttgtttcactttctggggttcctctcattgtcatttcaacatagatcctaaatcccttgaatttattttctgatggtggtctttaatggatattttattctatttttttattatctatttgttttagaaacacagtctcactctgttgcccaggctggagtgcagtgatgtgatcatagctcagtgtcgccccgacctcctgggctcaagcgatccttccaccttagcctcctaagtagctggaactacaggtgcatgctgctattcctggttacattttttttttttttttttgaagatagggtctgtctgtattgctcaagctagtctccaactcctggcctcaagccatcctcccacctcagcctcccagagttcctggattacagacgtgagctatcacttctggctgacatcctattctagaagaaaaggctatatatgaaaagatacaatattcaatgcatataccaacagaatgagctcagatactgcaaggacaagggactgattaactacctggtgaaaagggctttctgttccacctcctaggggaagtgtagcttatgagcactccagggagatgaatcacatacgtggtgtgcaaaggcaccaccgagcagaatcgtccatcaaacagcgggtgttctgaacaaggcgctggagtgcttaagctgctggccacttttccaatgatcagttcttcaaaagtggagaggacaagaagtaaaaacaaaattgagtgatgcagggcacaatgaatgggtgttcatgggatgaagcagttgagggtggctttatcctggggcagccttgaatggctttatagttaagaaacggcaagataacacttgcttttatttctctcccaccgtggctgtggtatgacacagtgactcctcctcacctgtcttcactcagattgggagacacatactcttcttagtaaaatccaggtggcatagaagtttggagcttgagagaagctgggaaaaaatagacacaaaccgatgcacctctgacaatttattcttccacatgtgcagtgccctccttagccttgggaaccgagcacacgcagtgtgttcagcaagttgtatgcatgcccatctgaggctttcttcccttttctggtggagtgcccctggaaggtcacactctgccattttgtctcttattgaacatggctgggaagttgcatctccttgttgcttgcattcaattgacactttagtgcaacgggtgtggacagttagaaaatggcctcttcctggtgccagctgccaatttatccctttgagagacacaatatgataattgtcacaccatcacccgattcttgcctgacattcctggcgggtgggggaagagccctctcctgctctgctcatgcctgtctcactacctgtaacaggacaggaaagatggaagagctaacaaaaggaatttttagcaaatttggtgactgatgcttcatttcactgagacttggaaatttacaaattgtttctcacaactgcacatttgtggatgaaaaggttaaatgtacaagcattgattttaagtccccatcattcatttgctaaactggcccctaaatgtataaactccctcagcatttgctgtttgtccctgagagcttacagaattctacagcttcaaaaagatgctaatgtacttgcctgaactcaataagacacgcatggagttgatcaccaaagtagtatgtattggaggtagaactaaaatactttgaagcaatgcacaaagatatctaataataaggtgtgtgggtgtgagatggaccatgttaatcgacactttatttcttaagcatttagagtattacaataattgatcacctattaggccataaaaaaccctctacacatatcaaagaaaaagtatcatggagataatactttctgtctaactcttaattcatattattttgacattagtttactttaatttataaattaataataagaaagtagaaaatgaattcccacatactaaataaaaatatgaacatgcttaggtaaacaactcataggttagagatgaaatcgtgcaaaattttaaagtattattagaagtaaataataatggatatactaaatgttgaaatattatgttaagtaaaattagttcattgaaggaattatatccttagaaattttaagcaaaaaatgaagcaattcaaaagtggtgatccaagtgctcacatgaaaacaataaaaagggttgggcatggtggctcacacctgtaatgctagcactttgggagattgagaccggtggatcacccagagctcaggagttagagaccagagtaggcaacatggcaaaactctgtctctacaaaaagtacaaaaattagccaggtatggtggcactcacctgtagccccagctactcagaaagttgaggtgggaagattgcttgaacctgggaggcagaggttgcagtgagccctggtcacacctctgtactccagcctgggcaacagaactacactctgtctcaaaaaacaaacaacaacaaaccctccccccatacacaaaaacccagtaaaaaaaacaatagcacacatcacaagaatatgaagggaaagatataaataagagaataaataaaaaatataaattatgaagtgaatagtgcagttgagaaacttaacataaccaacagttgttctttgaaaaacaactaggaaaagaggcacatgtgaggcaatactgactaaggaataaagagacaaaaacaaataaacataaatgtagaagggggcaaaactagagataaaatacaggttaaaaagaacaaaataccacacttcaaacactgtgacataggggcaaaggttaggggaaggttccagaattttgtgaaggctggcttactaagaagtaaaaaaggagtggctcaaagtctttcaacagtttagagcatcaagcccagataacttttatgggatgttcaagaaacagatcatcccagttttatgcaaccacaaaaaaaaaaaaaaaaaaaaaaggaaatggaagagtccaaactcatattttaaggctgttgtgtcatccttaacactgaaacttgacagagactttgaaaaaggaaaagaaaatcaaaaatcgatttcaccatgcctgtaatcccagctacctggggagctgaggcaggagaatcgcttgaacccgggaggcggagcttgtagtgagctgagattgcaccactgcactccagcctgggcaacaagagtgaaactccatctcaaaaaaaaaaaaaagtctatttcagttatgaattactttcaaacatctaaagacatttttaacaagttttatgcaacggtgtataaataataatataccatgacccatctgggtttgtctctgtgcaatagagatttcttattaaaaagtctagaaatgaaatttatctcagttttggattaggagacaaaataggatcctctaaatggaacaagaaaaatcattgataatatttaattctcatatcacaaaatatgctgtaaattagaaatcaaatggaacttacttaagggagtaaaagaacataaacaagagcgtaaacactgccttaaatggaagcacattgtctttatcttttttttttaacctttattttatcttcagagacagtgtctcactttgctgcccaggctggagggcagtggcaagatcttagctcaccactacagcctccaatttctggtgtcaagcaatcctcccacctcagctcccttagtagctgggcctacaggcggccaccaccatgcctgcctaattttttatttttattttttgtagagaaaggatctcaaaatgttacccaggttggtcttgaactactgggttcaagcaatcctcccaccttggcctcccaaagtgatgagattagaggtgtgagcttcaccacactcagccacattatcttgaaattagaaatgacatgaagatatgtgccagatgatattttacaagtttggcaaatagaaacaaatcagctgatagtcaagcctaagttctgatgtgaatccacagtatccctgatgaattctgagtgagaagagtgaatcagtgcaaccactttggaaaacagtttaacatgatctgtaaatctaaacatccccagagcctgtagctaaccacagcactcctaggtgtatacccagtagaaattgaaacatatacggtagccaatggaaaaaatgtagaacaatgcctatagcagcgtggctcacaaacacaaactccagagaccatgcaggtcacctctgataatatcacagtgtcttcacataacaaatcttcatgtgccactcattatcacacatagcacagcactgtgggaaacgctgcagtggttttactcaactaaaatcatgagctcaacaagattccaaactgaggtttactttttttttttttggaaaatttaaggcaataagaataaaagcatatgcatgtttaaaaataaatgccagtcaaacaaagcctcatttgagaaagaaaggaaggaagaatatcctaaacataagattcatgatttttatggactgaatgtttgtgtcactcctaaaatccatatgctgaagtcctaaaccccaaggtgatagtacagacaattggaaattaggatgatttgacttatgatggtatgaaagtgatcacatttagtagaaactgtacttcaagtatccatacatcctgcatctttcacttttagtagaggattcaaaaaattacaggagattttcagctctttaataaataatagacatcagattagaggattgtgcccacgtataggctaatgtaagtgttctgagcatgtttaaggtaggctgggctcagctttgacatttggtaggtgaggtatattaaacgcattttttatttacaatattttcaacttatgatgggtttatttggatgtaacctcatgttagtcaaggagcatctatattagaaggtggggcctttgagaggttataagatcatgaaggtggagccctcatgaatgggatgagtgcccttattaaggagaccccagattgctcattggccctctttctgctatataaggatagaattacaatgagcagatgccagtctgcaaccaggaagaatccaggaagatcctccccagaatcctaccatgttgggaacctgatcctagcctccagcctccagaacagtgagcaataaatgtctgttgtttataagccacctgtattaatctgttttcacacacggctataaagatacaacctgagactgggtaatttataaagaaagaaagtttaattgacccagttccatatggctggggaggtctcaggaaacttacagtcacggtggaaggggaagcaggtgtgtcctacttggtggcaggagagagagggagagagcgaaaggggaagagcctcttaaaaaccatcagatctcatgagaacttactcactaccatgagaacagcatggggaaaaccagccccaagatctaatcacatcccatcaagtccctcccttgacatgtagggattacaattcaagatgagatttggttggggacacagagccaaactatatcaccacccaagtccatgatattttattatagcagctcaaatgaattaagacaatcatgatgattaacttagaagggaaagatgggtttgtgaggagatcattgaataaattaatgtattgtcatggtattgacttttgtttggtgtggtggtttgtagatgcttactgcattgtatgcaatatcaaattaaataactaaatgaaactcaatgaaaggcaccaccgagggccagtcatcagtgtgcatgacccagatattatgatgcatcaaattctgcacatccatgtgccaatataaaccagatgtagcagtttgccagagaaactttgtgaagaagtttattctgggagaatgagcaatggagataatgtgcataggtacccaaagcatgagcaccctatacagggtttgagaagcatgcttgggagtgatgcctctgtaagtttgtgtgcacaagaggccaagagcttctcaggccagagagcagggtcttaatggtgtactctgtgaatttttacaataaacaaaggaaaggggaattaaaggcaaaaatagggaatagggtattgctttcctaaaaaccactttctgggaactgtatcaaaaattctttttttttttttcacttcttgagacaaggcctcactctgtcacccaggttggagtgcagtggtgcaatcacagctcactgtagtctccacctccctagctcaagtgaccaccacaactggctattttcttaaatgtttatttatttatttttgtagagaggaggtctcgctttgttgctcagtctggtcttgaactcctgggctcaagtgatccttccacctcagcctccaaaagtgctagcagtacaggcatgagccaccacacccaacccatttaaaaaatggttaatgtagcaatttgtttattgtgctgagagcagcaatgacatatgcttggatttcgggaatatagatatgtttcctgtcaagtaaagaatcataaaggagagttctcagttcttagccctaacacacatccaccagcacatagaagatacacacaatttattttgggtgaatatcaagtctcttatttttactcctatacacatccatgagaaagctggtttcaaaaaattaggtaaagttgcccagtcaatcatgtatgcatttgcatgtctatattagtcttccccaaaataaaaaatatatatatatagtttttttttttctaaatgcttttctagtttatcactctgaaaccgcatttgactaacattataacttggggttggtgaatattttctgaaagatatatatttttacatgtttattttcttttttaaatagacaaagaaaatttcatatatttaccatggatgacatgatggtctgaagtatatatacaatgtggaataactgaatttagctcattaacaaatgtactacctcacatagttataatttttgtggtgagaaaactttatagccactctcttagcatttttcaagaatacaacatgttattacatgtagccaccacattgtacgatagatctcttgaactcattcctcctgtccaattgaaattttgtatcctttggccaacatctccctaacccccaacatcccctgctaaccaccattctactctctacttccgtgatataaagatttttagattctacttatgaatgagaccatacgccgtttgtttttctgtgcctggcttaaaataataggtgtcttaggcttacaaactaagaaacagcaaagacatgaattctgtggtttccacgcatttatttttgtataaatacagttagtccaaaatgctgagatgatttaatgaagttaaagtatacccagaaattagaaatccctttggtcaatatagactactgaaagttattggggttatggcatgtttgtgtgtgagtttgtgtgcaccagaggccaagagcttctcaggccagagctcttctccatatttttctaaatgaaaggaactagtgctatttccaaacaaactcatatattgagtatttaacacaaatatcttaatatgtggcagtttgagactaatgaaaatgtgaatcacatatattttcaatcaaagctggtcatgaatagtttttttttttttaatctacataaatgtctgtgccaaatcttacctctcttaaggaacacactttttcttcatgcctcagctcggacagagtgatctaacctgcccactctcagatacattggctacaagagataaacaataattttaaatagaaaactcaaattagaaggaccctgaatattgaggagtctattgttgactcctaagacacaagatgagggccatgccctctcctccttctctaatttctacccagcagacccgagcacacacatcgtctggttgaaggtaaaaaatttatcatttgccttctggaaaagtttttcccaatgtagtgttcactacaccatttgggaagtttgctaaaataaagatccttgcattctacaccaagagaattagttctttgatgatgggtgagaaatgctcctaaaaaatctggtacttcaacaagcactgcaggtaaacctcattcagataaaatacatgaagacaccctgcattcaaaacagaggctttagagccttcaaatgcttatgggtctagaatgttcagcaagtgactctctttattcactgagcttggctaatgtcctagtgtgttttgtgttgccatgaaagaatatctgagtctgggtaattgataaaaaatttatttggctcatgatactactggctggaagattgtgcacctggtgagggcctaagactgtttctgttcatggcagaaggggagatgatttgtgcagagatcacgtggtgagaaaggaagcaagagagagcgcaagtgagctgccaagctcttttaaagaaccaactcttgcaggaactaatacaactcacccattactgcaaggatggcatgaagacatgcaagaggaatccaatcccaggacccaaacacctcccgttaggctccacctccaacattggggattcaatttcaacatgaggtttgggaagataaacatccaaactgtagcaaccaaccttccagctgagtgggtagcaagaatggaaatgctgaggagattgatggggacagctgataaaataaaggagcaatgtaaaaggatgagggggctgggtggttcttgatccaagaaaaggcttacctaatttccccctataattaggactaatattggaaagtgcatggtatgcaaagagtacacagtgatttgtaaaagcctgtggattctccaagacaaagatacattttccaataattaggaagtcctctctcatgagcacacttccctatcaggggtggttccatagggatcccagttttggcatgctttatcaggctacattaggtctccaccattcaaattgatgtgtatatctgatctgaggttttgaacagagttaacagtcagagattgtgcatttcttttctataaggaaacatttcataaggtctgaagtcattattttgccattagcaaatgcctattaatgcccttgcaagcattttaatttttactttgtggtgtatgccattctctttggcagacactgaaaaaggagagaattttaaatgctgttttgggtctgatgtgcatgccatcatttgcataggctataattaagctagtacagaattctcttggttttgagctgccaggttttattgcttctctttctctttctttctgtctttctctctctct[134 bp omitted]tcctgccacagcctcctgagtagctgagactacaggcgcccaccaccacgcccactaattttttgtatttttagtagagatggggtttcaccgtgt[136 bp omitted]tgacacctatgccttttgagatataactcccaggaaacacacacacacacaaacacacacacatgcactccaccctctttgagagatgaaaacagaaattaagaaacaatgtgaaagactaagcattcatttgaaaaaaaaaaatgtgagattctgagatgtctttaattagaaaatataaagaaatcaacagatcccccattgccagtcatgagggcaattaatgtaatagacttaataagtacaatatcacataaacacccccatctcctagacaacttggtgttttgtctttgagtcttcagcaactaacacaatatcattgaaattatttgatgaatgaattaatttatttcaagttgttattaggtctttactttttttttaaatgagtgcatagtatattatacatcatttataaggaatttattttcttagatatgtgttaggttcagagcataattgagtggatggtccagagagatcgcacatatctcctgccctcacacatgcactgcctccgcaattatcaacatcccccaccagagtggcacatttggtatagttgatgaacctatattgacacatcattgtcactcaatgtccatagtttacatgagggttcacccttggtgctgtacagaacgtgggtttggaccaatgtataatgacatggatccaccattacagtgtcatatttgtagggctacgtaattacagcgtgattatactcttgggactgtacagcacttttgttcatggggatttatttttcagttgaattcctactactttcaaacacagattatatttgtctgatattctaactgctttagaaatctcctgtctccatatcaaaagctccccaaactgtgctcttcttcttcattgtttctttctaaaaagttagaaaatagcatcactcccttcagaagtgtcgaataatggagatatctgcccaggaaaactttttgtgtcaactgtcaaataaaaaatgtagcagtttactctgatgcagtgataatgtattaaactgtggaattacgaaagtgtaatttgttataggagaaaatgatacttccactcttaaggcaaaattttgacccaactgggcaacataaaggcacaattcctgtctcaattaattgtcaatcttagcagtagccttctctgttttcacaacttaacaattactttggttaaaataatgtaatccctatcaaacaagattctctagaatattaggaattactaaatgctaggcattactttctcatatgtgaaccactttcatcgataatttctagaaaacttccttgaggtggtagaatttggaacatgtttagaagatagaagaagagttcagatgctgtctgctttaaaattgtcaagataaccaatattaagatcctcaagggcctggttcgcacctgtaatcccagcattttgggagacctacagggagaatcatttgaacccagggattcaagaccagcctgggcaacatagtgagacccccacctcctcacacacatatacaatcctcaaaatgtagacttttagtgtgaatttcctcatgcctcttaaatcagctacatatcagaattgtgtggatagcaagaaagggagattttcaatgtaacatttaaaaaatgttaaatgtccgaaattgcaaatcaaattatacaggcacatcttatcatatacccatttttatttgtgatgaagtaggcattaggataggaagaaaataaattagtaattctgagcagaaaatgagatttgatttacaacacgaacatcaattctgggcacagcctgcaactcttaatgtttctttaaattgaaattgatctgcttttctcaaagaatataatttgaagcaccttacaaccaattatcctggaatgaaattatttaaaatgtacacaggacaagctacatttgttaatatgtacccagttcatttgctaatgtagaccataacaatttttgaaggtgtttatagaattgccaatagatattcaacagaaatctattggatttatggtaaaagcgagtactgtagtgcttatttcaatgcattttttttttttttgctttaaattattaaggaggcttagagtgttgcagatgagtgttgccagatacaacagtaagacttgattagataccaagaaataatcttgaaaacttattgaaggcatagcaaggatttactcaacactcttctaagcttaagtacttctaaacattaactaatatttctgggtctgaggtttccatgtctttcagaataaaactgctcatcctctcaaatgaagagtcattatctgcagtggttctgctgtcatcctgatttgagtttgaaaacacaggctgcctttgcaagtccatgcctcactgggtcctgaagagagtgcatttgtcctgtttaggaaaacaggttcccaggaggaaatcaccacggtgggaaaacatttcagaagacttgtgtcttgcgggcttcttgttcaataaagctctgctgtccccagtccagcagaatccaatttccagaaaatagagaggaagaggatttcatttgctacattgttttttcttttgcaacttttatgttagattcagagggcatatgtgcaagtttgttacttggttatatcatgtgttgctgaagtgtggggtacaattgatcccatcacacaggtactaagcatagcacccaacagttagcttttcaacctttgcccccctccctctccctctaatagcccccagtgtctagtgttcccatctttatgtccacgagtacacaatgtttagctcccacttataagtgagaacatacagtaatgggttttctgtttctgccttaattcacgtaggacaatggtttccagctcacagtggctcacacctgtaatcccagcactttgggaggctgaggacaagattttgggcccattgtccactttggaaatcattttgaaaataaaggactggccatggtttcttctacctttcatcttccttaacgcgttactgatacctaatttttctctatctctatatgtatagcagtgtgtgcatgtgtatgcctgtgtgtgtatgtggggttttttttcacctattcctccaaacccttctcaaaaaaattggtgagttattttcatttgaggaataaattcattgcacaaatttgagagactcagctctatgaataagaatcagaagttacccaggaaatatatatatatatatatatatatatctcccaagagatttctggaacgaagtttgctactttctcaacaacactaatatttgcagcaaaatatgattttgatttaaagcagtccttcagtcataaaattgaaatctatgaactcttttggacacagctttgatagacttgatttcctgagcaattttgccatctgtcatgaagctgtaagcactgacctgagctattcatcttcattcacttacagagtagttcttttacacagaagtccctgagattgtaggagggtttttgatttacacagaattatgggacgtgtcctctcagattccctcaactacagccctgataagtagccataaaggaaatatgctccattaggtctgaagctcagaaaagtctgatgccacatctaaggctgtctatgccactttgtaccacctctgaggtgtctgcccagcaagcattttgtttcaaaaaagatgattgcacagttctgcataaattgaaaagtgtcatataatctcagggtcctccatggaaaagaactactctgttaagtgaatagaaatgaacagcataagtctgtgcttgtggcttcttgacagatggcaaaatgtatcagaaaaccaagtctagcatgagtaagttaaacaacattgatatttgcgaagtaaactatctttatctaaaatcctacaaggaggcaaagaaatatgaacaagggaagtcacagaaagaatctgtatggcaccaaagcaggacgaagaaaaatgaatgtgtgggatgatacagccacagagaattgggctcaatctggcagggtgctctgttagaaatatgtgggagaggggattgcattgtagtccttctaggcagtaactcttggtgtaaatccatgataacatcttactggaatgagttattttccccttcataaaatctggcagggtgtgtgtttatgtctgtgatctgccatcctgtttgggtaaagacctattccttccttcacaccaatccaactgcagcagtcagggtctaataaatgcatatagatgcgttaggttaaaaaaaaaaaaaaagccctcagcatgctccattaatttagatgctccgaaaagtacataatgctcaaaagatttaatcttcttgggggcacccagagatttgaggaaacaaaagaaactgcacattgggtgatagcttagttcctatgagttaaaatatttctttaagttattttgttgaaatggccaccatgattgagcaatccgtaaaaaaaaaattaatttgaagaacctcaaagaattttccatctggaagatactactgggattagtaaaaaacatgatagctgcattgaagtatgtggaaatggctatatctaggtacaaacgcatttgttctaattaatttacagaaggagagcaaagatgaagagtgagttgatgaagataaattgataataaactaagtatatggtatgttctttatatctctgcactgaacatatagaaatgattaaaactgtattaagttggtgccgccaacctaatataaacgtacacacacttatgtatatagcaatgactgtatttagtatgaggatttctcaggaagaccacacatacaggtaatagacaggaaacagatggaaagaagccagaacttggaggaagcatcagaatgctgggcatgacaggaagttctgctaagtgtgaagaagcaaggcactgcaaacagggaaagggaaaaaggagaaggcagattactaggtatgggaacctgggctactacaagagcagaatctggacttatggatccggtagcaaactcacatgaattagattagcaatgttgaggatggttgactccaggtgagaacagagaacatgcaaacttattttcgaaactgggcacctatggacacaaagaagagaaaaacaaacactgggaccactcagggatagagggaggaaggagaatgagtaacaaaaagctatctattgggtgctgtgcttattatctgggtggtgaaataatctgtacaccaaccccctgcaacatgcaatttacccatgtaacaaacttacacaggtacccctgaacctaaaccaagagtttaaaaaaatgaagagtctgaaagctaacatctatcacccatctaaatagcataaaatctgccaagagctaaatgtgcatcccacaccagaaagtctaaacaagggctctatcagagagataagagaatctcaacttaatgatgaacacatacttaacatgaacagctaagcattattgatgcattcaagagccataaaccaaactgatgcatgtgtcttcaaaatcaatgaccatttgaaaataatgcccatcatgcaatagaaattatacatttgataatccaaagaactccatctaagtgaagagttgatcaaggaaacagaaaaatatatttaattaagtgtacttaatatattcaaagatataaataagagaactgggtctttacaacaacagtcattgtcataaaaacacaagagatagcttgtaaaaaaataacagattgggcagggtgtggtgactgtaatctcagcactttgggaggccgaggtggagggactgcctgagctaagaagtttgagagcagcctggataacatagcaaaaccctgtgcctaccaaaaataaaaacaatagctggatatgatggtgcatgcctgtggtcccagatgcttgggaggcagagacgggataattgcttgaacctgggagacggaggttgcagtgagccactgcacaccagcctgagtgaccgaatgagactccgtctcaaaaaaaaaaaaaagaaaagaaaagaaaagaaaaagaaaacgaaaagaaaggcaaaaaccataattacttttgcaccaacctaataactttctggcccctgttttaggtttttgtttttttcttttcttaatatcatcagtgtcacttgggagataatgaaaagcttaggtccaccaagacctgtagaaataggagccatcttgaagacacctaagtgcaacatattaaaatgcattgctatccattctgctatgcaatattgccctgtacgattcagagaaagtaaggtgggttattcactgtagccctaatgtttgctgcatgagtaaacagacatgcacacacacacattcatacacatgcatatgcacacacacaataatgtttgaaaagtaccgctgtggccgggtgtggtggctcacacctgtaatcccagcactttgggaggtcaaggcgggcagatcacttgaggccaggagtttgagatcagcctggccaacatggtgaaaccccatcgctactaaaaatacaaaaagttatcctggcatactggcaggtgcctgtaatcccagctactcgggaggctgaggcaggagaattgcttgaacccgggaagcagaggttgcagtgagccaagatcgtgtgactgcactccagtctggagaacagggcaactctgtcgaaagaaagaaagaaagaagaaaaaaagaaaggaaagaaggaaggaaggaaggaaggaaggaagaaaggaagaaaggaagaaagaaagaaagaaagaaagaaagaaagaaagaaagaaagaaagaaaggaaggaaagaaagaaagagaaggaaagaaaaaaagaaagaaagagagaaagagagagagggagggagggagggagggaggaaggaaggaaggaaggaaggaaggaaggaagggtactgctctaacacaaaggtagtaatttcttaacataggaaatatcttcattgctggcaccgtcttaattattgttataaaatcctcaaagtcggcaaagaaaaatcaactctataaggaaaaaatacagaaaatatttaaagtggaagaatcttcttgttttcttcaatgtgtttctaacagtttgacctcaagttagagtctggctttcagaccttctatgcatctattgtcttcatcaatacaggcaaagattgtgattggtgttatttcttctgctatgtccctacagattttttatcaggaggaaaatggatacacttgcaaagagatgttggcagcagccaaccagaaaagccctaaaagtaggccagtgggtgcaagtgggccccagagtattcaagggaatctcagtggctcaatgaggcaaggagccactcctgccgttctacatgaatgaataagaaggaactgaataagggagaacacagaaaaactcatttctaggaaagcctgcactagggagctccaaatagcattacagtgcaaagctttatcagaaaacgtagcatgcccactgttcattcatggatggttatggcaaagacatagagatagagatagagatagttatagatagatatatgtattagtccattcttacattgctataaaaaattcctgtggctaggtgatttataagaaaaaaagctacattggcttatggttctgaaggctatacaggaagcacggtactggcatgtgctcagcttctgggcaggcctcagagaacttctactcatggtaaaaggcaaagcgggagctggcacgtctcatggcaaaagtaggagcaagagacagagtggggtagggaggaagtgtcacataagcagatctcataagaactcacacactatttcaaggacagcaccaaaccatgagaaatccatcctcatgacctaaacacctctcaccaggccccacctccaacactgaggattacaattcaacatgagatttggcaggaacatacatccaattgatatcatagttatatagactcagatgtattcatataaatagatttagatacagaatcatgggctgcataattatatttaggtcaacaatgagccacagatatgagggtggttctgtaagattatgagaccatattttcccataccttttctctgttttaccataccattctctgcaactaccctgcaatacgtttcggtacagaaatagttaccatactgttacgactgcctatactatttagtaaaggaacatgctgtacaggcttgtaacctaggagcaataagatacaccatacagcctaggtgtgtgtttggctatcccatcttggtttgtgtaagtgcacactaggatattcccatgatgacaaagtcagcctaacaactcatttttcagaacatattcctattgttaagtgacagatgactgtagttatttagatatagatagatataaatatagctacatagatgtaggtatagacatagataacagagatgtagatgtatatattgttacaaatatataaatatatgaatacatatatacatataggtgtgggtatggttatgaatatatatgtagatatgtttatagatgtagttgtaattatagatagttatagatatgtagatagagatagagacaaatatatagatatagaggtagttgaatagatatagatataggaatatagatgtagatctatagacatataggtataggtatgggcatagatatataaataccgatataattaacatatttatggatagagatatagttacagatatagatgtagttatagatatagttataaatatagatgtaattatagattagatgtagctatagatatagatatagttatagatatagatatatttataggtatagatatatttatagttatagatgtagttacagatatagatgtagttatagatatatttatagatacagaagtagtcatagatatagatacagaagtaacatagatatagataagatgtagttatagatatagatgtacttatagatgtagttatagatatggttatagatatatatgtagtatagatatagtttagatgtagttatagatataaatgtagttatagatatatttatagttatagatataggtgtggatgtagttatagatatagtcatagttatatatgtggttatatagatatagctatagatatatagatacggatgtagtatagatatagatatagatgtagttatagatgtatagatatagaggtagttgtagaagtatagttatagatatagatatggttatatatatagatgtagtataaatatagatgtagttatagttatagttgtatagatatagttactacttttaccatgacttttaatggcaaaaaccacagttacttttgcatcaaccttatatgtgccatatgatcttatttaaataaatgagtcctttttcttatatttcaaaattttgattctgtgcatttgaatatttttttctctaatcatacttgggaaccaattctatttgaatagttacttcttaggatgaaaataaaaaggaacctttaagaaatattgagaataaaaggttgaccattctgttatgcactgtagtcttgtaaatttaggaggagcagttccaagtatttactgtggctccaatgttttggtgtgggcacatgcacacacacacacacacacacacacacacacacacaatatcatgatcctactcattccacatctccttgtctccagaaagacagccaatgaatcactgcactataatgaacaagtaggtgcctacttgctttgtgtcctccagctgatgaatgaaaattttaatataagaaacaaaatttcagccctctctcattgactcagttctaaaactgatgatcctgactcaatcaatagagagatgaataaagcacaaaaattagtgaagctgatgatattttcccagcaatcttcccttaatatttaagaaaggataattaatgttttaaaaatgagcctttctctgtgcaaatagcctcaatactattgtattttaattcgtcaatatagtgaagaggcaaaagaagtaggaaaaatattatgaaatacaattacaagggctgcaattcccattgtaatggtgaattggattctaaatatgttcaaatatcctacacacccatcatggtgcctagtgaatccctctcctcatctacagttctctaaagacatgtcattatttggtgctcattttcttaaataccatttcctctcctgccttctatcagcaaaactactgaaaatacttttaatgttttcgacagtgacactgttgttgctaagtactttgaaaattttgcagtatttttttatgagatttcacagccatgtgactgtatctctgaattctctgggtgacaatgtctccttgtcacctggaaacctgctatggaggaagagtgagtgagagataaaccttggttgacttacactgtggagatggaggattgtttcttactgaagcatcaccttgtgtatctgacagatatatcagtgttctgaggttgtacaatggcctttgcaacttgatatggtttgaccatgtccccacgaaaatctcatcttgaattgtaggtcccataatccccaggtgtcatgggagggacccgatgggaggttattgaatcaggggggcaggtctttcccatactgttctcttgatagtgaataagtctcacaagagctgatggttttataaaggggggttcccctgcacacactctcttgcctgccttcatctaagatgtgactattttgctcctcatttgccttccaccatgatcatgaggcctccccagtcatttggaactgtgagtccattaaacctctttcctttataaattacccagtcctgggtacgtctttattaacagcatgagaacagactaatatacaactcatccaagaaatccctcaaacactatacttatgtgactattcataacatatattactgtgtcttctgttttaagtttgcttcttctggttttgggttctctcaaagtctcagaacctactgcctttatattctgcccaacatcgctgcttgaaaatctgccagttgtgtactgtatttaagaaattcacagtaaagtattgatgatgttaatataagggactgctcattcaagaattttttgctcattcaagaatttattaacatgacataatatcttactatggtctaaatgtttgtgttccctcaaaattcgtatgttgaaaacctaatcatctatgtgattggtttaggaggtggggcctttgggaggtgatgaggccatgaaggtggagcttcatgaatgggattagagcccttctaaaagggaccccagaaagctcccttgcccttttcgccatatgagcatccagagagaagtcagcagtctgcatcccagaaagtggcacttaccagaacctgactatcctgacaccctggtcttgaacttttcaggcaacagaactgtcagaaataaatgtctgctgttcatgaactacccagtttatgatattttgtaatagcagcctgtattagtcaggattctctagagggacagaattaataggatagatgtatatattaaagagagtttattaaggagtattgactcacacgatcacaaggtgaagtcccacgataggccttctgcaagttggggagcaaggaagccagtagtggctcagtccaggcaccaaaagcagggaagccgacagtgcagcctttggtctgtggccaaaggcccgagagcccctggcaaaccactggttaagtccaagaggccaaaagccaaagaacttggagtatgatgtttgagagcaggaagcatccagcacaggagaaagatgaaggctggaagactcagcaagtcaccttcttccaccttcttctgactgctttttccagccaagctggcagccaattggatggtgcctacccagattgtgggcgggtcttcctgacagtaggtcctccttttccagtgcactgactcaaatgttaatttcttctggcaacactcagagatacccagaatcaatactttgcatccttcaatccaatcaagttgacaattaatattaaccatcacacagcccaaatggactaagacaatattaactaccaatagttaaattcaggtctatgatgacaaagattttgagtgtagatagctatgtgacatattgatttcagatcctttggatatatacctagatgtggggttgctggatcatacgataattttatttttaggtttttgagaaacctccatgtggctttccataatgcctgtaaaatttacatgcccaccaacagtatattatgtatatttcaaaattgcaagagagtacctttcctatgctgtcaccacaaaaaatggtatttgatgtaatgcctatgttatttagtttgattttaagcattctacattttatacatatagcataatgtcactctttaccccataaatataaacaattataattagctaatcaataataaaataaatttttgaataagatttctttaaaattaaagaaggatttcttttaaaaagaaagattttgaggaattttctcctctaggtacatcagaatatgcaagaagcattagtgttacttaagattatcaattcaagttttcgtccatgttcagttaaatttgcatgtttacttaaatcttatttgtggaaagaaatagatcaatatagaaaaattaaactgtttattttgttaaatatatctcttagtatgtaagacttgtatcatatctgtacaatttgattcagattacccgaatagaacatgggttgtgatgaaaatttataaaatggagttattacccttggtttcttatagaaatgaggtttcctaccaacaagcttaaaaactgaacaggaaaaccccatgcattatgtaacaaaagcacctagatagttatgctaaggccaacagagcttgagagtaaaataaaattttactctataataacatagatttttaatagcactttttcatattttaggtgaaaatatgatgcatttttaaaaagatgctataaggaaatatcaatgataggctttgacacaataaaatgctagcaatatccgaaatgggtataaaattaacacaatgcattttactgcagacatgggctatgtaagacatgatgttctatttcccactttactgtgttgggcaaggcacagtgtttcaattcagttgaatctgacctttactcgttatgtagatatgtttcttttttttgtttgagtcagggtctcactctgtcacccaggctggagtgcagtggtgccatctcagctcactgcaacctctgcctcctgggttcaagtgattctcctgcctca[221 bp omitted]tatgtaaaagagaaatatgctaaattggatagacatacattgtagagctcagttacaaggctcatacgtggtcaaagagtgagaagagcaagatggaaaagatatgcgctgcatggaaaatgggtccttgtgaataatccaaccttccaggtagtgaggagactccatttttatttgaagtctatcacatgaagacaggttgtagaaaacacttagaaaactaattgggcataccaaagaggtgactgagtctcttttgtaggggagaaggaggttaaatagaagttggagacaagattgccccagttattgactgcaaacctgaattttttcgttatgggggtagagcagaatcattttatatatcatggattacacttaggtcagagtgaaagatagatagatagatagatagatagatagatagatagatagatagattagattagatacatagaaggtagattagatagatggataggtggatgtatagatggacaggtggatggatggatagatagacgactgataaatagtagataaatagatgatagattagatagatgaatatctagatggatggatagattgatggatagatatgatggatagatgatagatagatagataatggataaatgatgaatggatagatatgtagataaataaatatatggatgtatgatagataatggatgaataagatagacacatagttatataaacacatacatagagacatacatacataatgaatgcatgacagatagatacatagatggatcatgggtatattattgagtagatagatacatagagagataaagagatagacatagatagtaaaagacatagacacatagtaaaagagatagacatagacagatagtaaatgggtgaatgatggatagatacatagataaatggatggatggtagatagataaatagatgacagataaatagatgatggatacaagatagctagctagatagcataaagagataatggatgaatagagagagagacagatacataaacacacacataataaatgggtggatgatagatagtggatcatggatgtatgatagacagataatttagatagatagatgataggctgatatagatagatagatagatagatagatagatagatagatagatagatagatagatagatgatagatagatagatagatagattagatggatggttaggtagatagagagattatagataaagtgggtggatggataaacaaatacataattaaaatgcacaaagttaaacatgaaagtttcatgtaaaatgtacacttttcagctttattgtacagtttccagctttactgaggcataattttcataaaatactttttaaagtgtaaattttatgagttctgttaattttattattctgtgtaactgctgccaaacaaggcaaaccagttggagcatcctaccacgttgctttattctccttgcagtcaatcctttttcataactccctgccccagacaagcacagatccatttcccattcctccagttttgccttttctagaattacatatatatggcatcttgcacgtatgcacacttttgtgtctgatttctttcacttagcatagtgtttttttaagatttatctatgttgtcgcatttattattttttttttgcctttgatacgctgaagagttttcgttgcatgaaatggataaatgtttattcattcactagttgatgaatctatggttggcttttagtgtttttttttaatattgtgaataaagctgctttgaattcatgtacaagtttttgtaggcatatgttttcatgtttctttgatagacacttagaagtgggattttaggattgtgtgattagtgcatgatgcaatctcactgcctttcaaatagattaaacatatttataaacagttgacttcttgcagattgtctttcttatattgtctccaaaatgttagcaaacagtgatgttactattaaggatttgataacttaggaagatgttttgttgttgttgttgttttgagacagagtctcactctgtcgcccagcctggagtgcggtggcaccatctccgctcactgcaacctctgcctcccgggttcaagcgactttatattaactccatatggtcagtcaaatatttatctaagaataagagtacaccagcagttaatttctccaagcaccatagaagtttttagattgtttaagttggcatcaacagactagtattgcaaacatacatctccagtcaatggtatgtcctaaatgtccacctattatctgtaaaatttcaacgtatattgaatgtgtattttcaagacagccagttccttaaaaacatcctatttcattctagatcacagagtgtatgcaaaaaggatgcaaactcaatatgaacatctttgaagtattttcctctgttctatccctttagggtatatagtgaataattttggagaatgggtgactaatttttcatgtaccagtttctttttctccaatttttcctacgtgacactgattcttttcattcaacatgataatgaataatactttgaatccccaatagaaaccaatgagcagatacatagtttgttgattagatttttttttttttttttttgagagaaggttttgctctattgtccaggctggagtgcagtggtgcaatcatagctcactccagcctccacctcccaggctcaagcgatcctcccacctcagcctcccaaagagctgggactgcaggcctatgccaccaaaacagctaatttttgtattttttgtagagatgaggttttgccatgttgcctaggcttgtttcaaactcctgaactcaagcaatcctcccatcttggcctcccaaagtgaagatctgttttttaaagatatcaatcccttctgcaagccaatggaatgaagaacatttgaaattataaatatggctttgaaattggcagagttcgtcgttcttcaaagtgactcacttattaggtacattactggcttcgtagcattacgtcttcccaaaatgctaattttattgtgggtgtggttattgatttacaattgcctaattagaaacaatgaaaaaatattgagttcaacttctctatgttgtaaatatttgttgattgtgaatagattagcatgtcatttcttgagttcagaagtggccaaaagtatccatgtgaaaaattacatttttaagtaaaacaattatgctatacttgcacgttgatcttttccctcaactgtaattcattaggatattttataacaccaccaaaagtcaccataatgatgcctttccttttgtaaggcaaattataatctgtttatcatccctgattgaacaaattaaatctaattgactcttctttagtcagggaaagattatgttgtactttctatgggagaatgattttcttggaaaaggaaggtcaatataaacaattaaaagaattagtggttgtactgtttgaatatgtaatttcaagcaccatttatagaattctcaatttaaggggtacccaatggctaatagttgaagaatattcatgagaacatcaagcttcaaggacaggacttatttcttcattaaactggggcaggagagaaataaaggtttagaaaataattaccccttaaagtatccttaaatgcataactctctttttcattttaaaaaatctcctgagcatatgaatacatgagctctttcgattttaaatgagtttttgtttatcttttcaatgtttactaagatgttacaagatttggcattgaaaccagaagttggcctatcatcagaaaatcacatgccactaaagaaaatataaacttattgaataaatccactgacatatattgtgtagattctaaaagctgatctatatttatttcattatattttctttaaaatctagtactcacgacttcaggaaaaaatttccagttttttttttttctaaccttgttttcttctactgagattgataaataatttatttaccgtgactaatctatcatggcatggcacatattgcaaaagtatttcacattttgagaataatattgatatatggatacttggaggccatatggctattaggaaaactcaatgatctgctcaaatacttcagtaaaaaaatgttgctttgttttagaatatatttctgttttaatgttgagtttgacagtatcttaagttctgggaatttactcaaaattattgaaatcaatataaaaggacccaggacattgctgcacttttcaaacatgtagaagagaactgtatgaagttggagtaaatagcagctgcatttatttatacactgcaaattctgagtggctttgtacaatgaaggtatatatttcacatcgtggtggctatcatcatttgccttggacagaacccaggtctctggccccatctctttctttctctttctctctctctctctttctctcttatatgtatgtgtatttatatgtatatatgtgcatgtaggatacacatgttatatatcacatatatgtaggatatctctttctatatatctattatctatatatatatatattattcacccatttctatctatgacttttctaggcatttggatatatacttacttccaattgtaaattattctacagttctatgtaagtccaaaaactaaaacataccatatttattataatcttatgaaaccatatctatgtatacacacacacatatatatatattatatatatagtttttgttttgtttttgtttgttattttttgagacagagttttactctgtcacccaggctggagtgcagtggcacgatctcagctcactgcaacctctgcctcccgggctcaaatgtgtttcatgcctcagcatcctaagtagctggaattacaggcctgtgtcaccacatccagctaatattttttgtatttttagtagagatggagtttttccatgtttcctaggctggtctcaaactcctggcctcaagtatattttgtttttaaatcttccataagtaatatcagcccatacatatctttacataacttgcttttttaacttaacattaggttttccaggtatattcatgttgagatgtgagtgtgtgtttttgagtgtgtgtgtgcttatacacacatacagtttctccaaattatggtgttttgacgttatgatggtgtaaaaatgattctattcaggggaaaccgtacttaaaattttcagtgctgatcttttctggggctagcagtattcagtaggacattctctctggatgctggacaacagcagggagccagagctcccagtcagccctgagatcatgagggtaagtgaccttactccacagtgaactgtgttgccagatggttttgctcaactgtagactaatgtgattgctctgagcacattttaaggtaggctggcgtaagccatgatgttcggtaggttagatgtattcaatgcattttcaatacaatattttccacttatgatgggtttaccagaacatagccccatcataaatcaaagagcatatgtatttacataaaggcatacattgcttaataagggggatacactctgaaaaatgtatcagtaagcagttttaccattgtactgacatcatagagagtatttacagaaacctaagtgacatgcatattttcacttatttatgtttttatgtgaaaaactaaatttctcagcaccattacttaatatagaccttttcccctacttgatatgcaatgccagtatcaagtgtgatatattagttttctctctatgcttcattataacctttgggactatatatatgatatatatccacatatatgcatatatatacacatgcatatatatacacacatatatatatcagccattgcttgataagtctctgtattattaaacaataagtactttatttattcttccattttgttttctgagacaggtccttgctctgttgcccaggctggagtgcagtggcattgtcatagctcactgcagcctcgacctcttgagatagggtgatcctccagcctcagcctcccaagtagctgagactacaactacatatcaccacatctggctgttttttctgtttttgtttttagagacagaatctctctctgtccaggctggagttccgtggtgcaatcttggctcactgcaacctctgcctcccaggttcaagtgattctcatgcctcagccttccaagcagctgggactataggaacccaccactacacctggctaattttttttgtattttagtagagacgaggtttcaccatgttgcccagggtggtctcaaactcctgagctcaggtaactcgcctgccttggcctcctaaagtgctaggattacaggtgtgagccaccacacccagccctggctaatatttgtagagagaggatctcttggtcacacagactattggttcctctattgatcaataataagatcacttcctgcttacctctcagaatattcaaactgttcaatataatctccagatgtttctcaatgcagagactgatgtcgggtgcttgagtttgacagatttcatttcactggagcatgtagcatgtcaacaagaaacagagcctaacttgcttttctttatgacaattctggaattcaaacctgtgctccatatatgatcaatgtgtgatacctgataattaagtacacaaactcatgtatgatttttcctgaactacaaaggccaacaaatgtctgcagaagccttgttccttgggaaaacactgttgccttcactctctgggatttatgcagaggaataaggacatccttctgcaattgtgcgtcagctttggggtaacttaggaagagatatatcatgtttctctttcatctctcattctatgaggctgaatgagtgtgtcttctttgtttatttgagatgctacctatccattttccactctgtacttgaaagcacccaattttcattctctagcacaaatactcttgctataattgtctatctcaacccagctctttgtaccaaatgtttggatgattcaattctttgcttattatcattacaactagcatggcccttgtctttatttttggcaatacccctgagttcctatgcttcttctccttaggaagcttgctttcatccttcctccatctctccctgctatggccaaaccaagaatctccattacgaaagttgtattgccttcttcttttctgttcctaacatgccaatctctgaaaatcaccttctgtcattcagctaatattttctagtattccaagtcctgcacaacttcaatataatctacactggaatataaaatccactcacctgacctttgttcattgtctctcctctcccatgtttggaggtaggaactgtgttggacagccctatgtaacaaatgacgtcagcatttccttagtgcctttaggaaatcttttgtgattaactataatccctcttccacattgttttggagttttaggtagcaccctggataatcaggtaattttatttgattgatttgctatttgatgaatgttctatttctctgtaacacctccactaataaaacaaaatgaactccaaggggctttaaaattctctccaccatcacagaaaatgttcctcttttgctattatttccttaagaatgcatgagatctatattgatatatccatttttactatctttatatggcaattataaataaatactgaacagtaaatatatgttgctttgagtgagtgaatgggtattttcagtcaaatttgtaatatgcctattctcaatctattttatattgttaccatttctttttctgtattcctattctaatctgtgcaaaacaaagattgtttcttccccaaattgctaattcttgccagttaaacccacttgctggaatcacaagcctattattttttttaaatgcagtcacttttgtacttttgataaaacctttttcttcttaaattgctgtagattctgctattgattttttccccttgatggaatttatcttctcattgcaaattaaatagcagtagaattttgcaggaccaatcttatttgaaaatgtgccttgtttcatcatgtctatatatttcttaaaagccacaaggctataacatccttcagttttatttgataatgtatctgtaagaattattacacattctcataaatatttaataaattttgctatggatgaaggtttctgtttcttcaaaatatgtattgaagccctaatctctaatgggatggtactaggaggtggggttttcgggaggtaataatgtttagattaagtcatgaaaatggaacaccatattgggattaatgcttttataagaagaggaagagacaccagaacttcttttcaccgccatgtgagggcacagcaagaaggcggccatctgcaaaccagaaaacgagccctcaccaaacattgaatctgctggttccttaatcttgaatttacagcctccagaactgtgagaaatacaagtctgttgtttaagctgccaagtctatggtatcctgttacagcagcctgaactaagacatatattattaggatttacatatatttctcatagaacacagttgaaattcacacccattgtgattaatatttaacaggttcttactgaagttaacttttttttctcttgtatgtattgttgaatttccttatgggaatgtttttatgaaatactgtgtctttccatgtcacttcagccccgtgaagtctgcatgtatactagaaggtgatcactaaacactgtattttcccccatttttacttgagttaggatcttggttgtggttaagtgacgtcagacagctacatcagagtgagatctgagtgatgacagctgtcattggccaggggttctgtgacttgcgtctcttagtaggggtttttatggggacagttctgcatttggcttggatatttctcctgcctgggtcacttctggttttgaaacatccatattaacttttaaagtgctcacaaattccattaactaacaaccacaaggtaataaattcatttctgcttaacctagttggaagacctgctattataaaggctaactcatggaaacatgagtttaatcatcctaggtttaattattggtgcagttaatgcttttataggggagcgctaggattcccacatacccaagaatttccaggacacttcaaggacacaaggctaatcttttccaaacttctcattcttctgcagttccaatttcattctttcttgtatcatatctattttttgcattattcataaactggcccttgaattttaagagacacattgttatgcaaaatcttgaaatgttacaattagttcaaagaaaggtatatttacctcaaggacattaattcaagccagtatgttttcaaaacctattttgctgtgtattgcctgatttttaaattagattttcaaagagtttactcccaaggatttgagatcaaacctcaaccttcacatgattctgattttatgagtaatgttggaatatataagggtatgtccatattaaatgtgctcatgtctttttgggtagttttcattttatatttttcattattgctctgggttaagaatctctaagttattactaaaatttccctgagatgatacttcctgatcgtttatgactctacacgtttctctggaaataaatatgatcatgtatttcagcatgtggtgccaagctccaaatgaaatcctataggtttaccaggacttggggcatatctgtactctctgtgagaggtgtgaaccgaatgcagtcttattggatttgcttttccagcagtcaatatttctcatccacaaggagctccagttcaattcaaacttctgtattcataacccgaatatctaccaagtcaagaaaatttttttaacaaaacaaaacattcatgaacttaacactttaaaataatcacttttaatgtctgaaagcattgctctcttgtctaattttcttcttctttgaacagagagaaatgatttacatatttggtatcagacattatatgctaccttatttgtcttctgttgatttaacactttatgacactctctccctgtgtgtgtgtatgtatatacacgtatatatacacctatacacataggtgtgtatgtatatacacgtatatatacacatatacacataggtgtgtatgtatatatatgcatatatacacatatacacatacatgtgtatgtatatatctaatatacatatatatctatatatactatatatactatatatctatatatatactacatagctatagtactatatatactatatatctatatatagataatgtatacatatatctatatatactacatatctaatactatatattagatatattatattatttatatattatatatttatattgtataatatatatcatttttatataaagtagacataatatagatataatatatctatgttatattgctgaaatgtattttaaaaatatttaagtgtgtgtgtatctttgtctttcattgcaataaaatacacataacacacaatttatcattttaaccattttaaagtatacaattcagtgtcatttagtacattcacaatatcctgcaagcagctcctctatctaggcccagaacatttttatcaacatcaacattttcaaaaaatatatatttatttttaaaatatatatatttaaatatatttttatacatatatttataaaatatatatttatatatatttaaaacatttattatatatttatttataatatatgttaaaatatatacattttaaaatatatctattttaaaatgtatatgtttaaaatatatttattttttaaatatatgtatttatttttttaatatacatacttatcttttaaatatataattattttcaaaatatatacacatttattttaaaaatatatgtatttatttttaaatatatgttttatgccatgaaatatcacaagggtatataaggataggtctttaaaaaccggcagcaagcattgcaataggcatgtagacatttgaggaattctcattcaatacaggaagaagagaaatcaaactaggctgtgatttgtattaaaagtgtgacgtgaaggagggcttagcttcaacaatgagataagaaacatcaggcctggtgtggtggctcatgcctgtaatcccagcactttgggaggctgaggcgggtggatcatgaggtcaagagattgagaccatcctggccaacatgatgaaaccacgtctctactaaaaatacacaaattagctgggtgtgctggtgcgtgcctgtagtcccagctacttgggaggctgaggcaggagaattgcttgaacccaggaggcagagcttgcagtgagccgagatcgtgccactgcactccagcctggtgacagagccagactcagtcgcaaaaaaagaaaagaaacatcggcaacattttggaagttgtgatgtatatggggtgagaattgccctatgacagcatgacatggcctatcttgattttagatctctacactcactgatcaacaaaatgcctgttattttttgaatttttgcaaccataggatgagcacagttggaaagctttacctacaccctttgtggagaacttctgacagttagcaatgtgattttttttttttttttttttgcataattcagtgggtgcattggcattggtgtttgctttgcattccctagaagcatattcagaacagaggttcatagaaaatttgttagaaagtgttcctaggaaaaacatatagtaaaacaggaatgtttctggggtcatacagtaattctgtgtttgtccctttgagggatcttcaagctgtcttccacagcacctgtaccatgtcactttccatgctcatgagcgatagataaggtttccctggtgtggtaggaccttgaaagcatcatggtcagtgaaagaagaaacacacaaaggccacatatcacattattctagttatatgaaatgcccaaaataaggacattctcagagacagagacagacgaccaaggagaacatagagtgtcactttgccataccctccactgcacttttctgaccaagagctactttgagtttcatgctgttaggataagggtcagtctttggcttatcaataaattttactctctgttagccttactggctttaagaaaataacttcttgtgtgttcacagctgtatttattccccagtttgcagaattgtataaataaaggataaaaggattattttaatgttactgcactgaaaaatgtatacggattagtgtgcaagtttacttagccgaaactttacaagtttctgttgaccttgctgattgagcatgactacaaaatattacataataaaaagcatttaccataaaaaatataaatatatatatgtatgtgtatacacacacacacacacacacacacacacacacatacatgttttacattgccctctatgccttcgtttcattttctttttttagaaggagtctggctctgttgccgaggctggagtgcagtggtgcaatctctgctcatctcaacctccacctccgcctctgcctcctgggtttcaagcgattgtcctgcctcagccttccaagtagctgggattacaggcacgcaccaccaggcccagctaattttttgtattctttttttagtagagatggggtttcaccatgttggtcaggctggtcttgaactcctgacctcaagagctccacccacctcagcatctcaaagtgctgggatcacaggtgtgagacaccatgcccagctctacgccttattttcttatttttcattgccttctatgcctgtaactatgtaaaagaaactacttaagaagctcaaagccttgggaaataaattcctcattggcttacacagaactcacacttgggttttggtttgtgtcttggttttcattttttgatgtgaacagaaagcagactggaggttgccaggggttgggaagggggacaggggagtgggtcctttttgggtaatgaaagtattctgggactagatagaggtggtagttgagcgattttgtgaatatccttaatgccactgaactatatactttaaaatggttaaaatgttaagttttatattatatgtgctttattgcaatgaaagagaaacttttattgcaataaattcattggaataaaagagatatataaaatatatacttacatttatataatatatacttatatttatatataattatatatatttatataaatatctaaaacaaatacattcatattaacatatattaatatatatttatatcacataaattttacctaaatattaatatatctataattttttcatatataaatatataatataattaatacatatattttaatatattatacattatatattacataaaaatatttatatatttataaatatactgtattttttatatatgtgtgtataaatatatgtatatatacacattttaacagtatttccagcctactgcaagtgtggtcagaataggctcacagggtgtttgacctctggaggctctaggggaggacaatttgtggctccatcactccagtcttcaaggccggcatctttaactctctctgctccatgttgacattgccttctcctgtccatgtgtgtccaaacctctctttatctccctttcataaggattcttgtgattacattgggcacacccagataacgcagggtgatcacccatctcaagatcctttctacatcttatctgcacagtgccgttccccatgcagtcacatacctctaggttctggggattccgatcagatgacatgtttgaagatgtctttatttagcctaactacacccaagatgattgttctctcttgctgaaccaagtaataacccaacttgttcaactacatgtgtgttcttggtgtgctttggctagaggacattgacacgttaactttgaaaacaaaaacagagactgccttctgggtaaatcacagaggtcaggtaatcaacaaataacctcttattgttcatagccctgtatacctacagctatgcaaaagaaactactaagaagctcaaagcattgtgagattcggtcgtgatttgcttactcagaatatacacactagtgttatggcttgtgtcttggtttttagctttttatgtgaacagcgaagctgatctggctccttttctagtgatgtggattgaggcacattattctctaccagagagtaacaaagttaatgtaaatgatttccatctactgcactgtagttcactggaccaagcttattaattcaactgtgaatagctggaaatgtggaacttgcattttaggtttttccaaagtctcttttttgagcagacattttgggttgctcaagaaaaaagaaatgattgccttaaagggatactttatcatgactctgctgcatgtgaaaggaattgcatcgaatttttccccaacagtagaaatagcccaaatcctgtgacaaagtaacagtaatctatttatagccaaggttaggtaaggaaagaacaatctttcttttttaatttccctgggtaagcattgatcaaattgcatttttcattcatgagaatatctctgaaatcaggagagattaagtgtatgaataattgttatatagttgtgtagaaagcaaaagaactttcaataaatttgttccactttttcctcaggtagtttcctattcccttattctttccctcctctgttcatttaattgtgaagcgatttattgaacatctattaagtgaaaggccatggggaaatcaaaatatgtgaggcagattcctactctcaaaggactgatcgcaaagaagagacagactcctaaaagaggcaaaaaccaaaaaaggagacatgataataataaatgaatgaatggggtggcagttttcatcatagtcaatattggagaagacacacctttgaaaaggcttgcagctcagtcaactttaaattaggatggtcggtttttgaaaaccttgcaagaagactggcaaatatagacttatgggtcttattcagggagttgtgcaacttgggggcaaataagaaacagtatccgtttcacctgccaacatcctcaaagatcagaatatccttcagtgttttcccctccaatatcagctgataagtagaaacatctaaaatacagtcatgcatcatttaactacagagttacattctgacaatgtatcatgaggtgatctcatcagtgtgcgaacatcaaagagtgcacttacacaaacctaaatgctctagattactacacacttgggctacatacctgtacaacaggtgactgtactgaatattgtagacaatttaacacaggggtaggtatttccacacctaaatatatctaaacagaaacacagtatgttaaaaataaggttattatagtcttctgggaccaccactctctatggggtctatcaaatagaagtctagtttgctgtgagttacacaacaatattataccttgcaaaaatattgtaagagttttgtgaaaacctgatcattggtaaaaagttgaaacagtattgaaggggggtggaacatatttgaagacctataaaataattttaggattttgccatgaagactaatcacataggaaaaaaaaattaccaaaaacctcattgcaggtacataaaatcttatagaagggcatatatcaaacctgaacttacttttagtccaatgttaatctaacaagaatgtttttctgcttgtcccattaccaatcaataggactggataaactggttttattcctgtcattcttataacacattgataaatttcacctaggtaatatactttttagggaacttaaccactttgtgtttaaatatgaccatcacagtatgttgcacacataatattctgaataagtacttgctttaaattgtgtatataaatcttcagattctccggtttacttgatagaatactcaggtgggcatagcactttacatgtcaatggtactttataacacattacagattttttataaaaacaacattttcttataccttatttcatctaatctgccagcaagttcctttaaaatgatatcactttatatataaaaaatacagcatcaagcaggatgagcaaattattcacagtctcataactcacaggaggtagaattgtcagaagcatttgaaccagagcaactccatcttgaataggggctgggtaaaatgaggctgagacctaccgggctacattcccaggaggtgacatttctgggacatcctgtgacattctaagtcacaggatgagacaggaggtcagcacaagatacaggtcataaagacctcggtgataaaacaggttgcagtaaagaagcaggccaaatcccacccaaaccaagatggtgatgagagtgacctctggttgtcctcactgctacactcccaccagcaccatgacagttacaaatgccatggcaatgcgaggaagttaccctatatggtctaaaaaggggaggcacgaacaatccacaccttgtttagcatatcatcgagaaataaccataagaatgggcaaccagcagccctcggggctgctctgtctgtggagtagccattcttttattcctttactttcttaataaatttgctttcactttcactttgctctatggacttgccttgaattctttcttgcgcgagatccaagaaccctcccctgggctctggatcgggacccctttctggtaacaaaatgaggctgaagaacctcaaatcttacatcttctgtaaatttattgttattaagttatttattattaaataaaagtattattttattttatttatgtttaaatgacataattgtatctatttctggagtacaatgtgatgttttgatagatccatacatgatgaaatgattaaatcaaactagttagcatgtttatcacttcactttcttatttgtatttttgtgtgggtgggtcaaacatttaacatcggctccctcagtaatcttgaaatatacattacattattaataactagagccagcatgctgtgccatagatttcaagaaattattctttctgtctaactagaactttcctcttcaatcaacatctccttattctctttctccactcctttgtccctggcacccatcatgctactctctgcttcggaaaccacctttgcaaaagtgatatcagtgagaaaattctaacagtaagctaagctaacccaacctccatcttgcctctcccttaattattttgggctagtggggcaaattaactttggaaaacattaaggctacattttaaatgataatagggcttacccccaaactcaaccacatttgtaaagctgatgggaggccagggggctgcggggaggagaggagccattattccagaagttataagatgtgccgcttccccaagcattcctgtaccactgttgaagattagccttttgagatatcttgccagtctttttgcatgtcttacacccacgactccacctggacctacaacccagcccctgtggccacacccagaagcaatccagcccgcaggaggacagcttcaacccctataagttaatgtctgccctaaccaatcagcagcaagcaccaattacctggtcacctctacctcttcccccaaactgtccttgaaaaacgcctaatctacaagcgtttaacaagatgatttgagtatgaattccatctcccacgtagtgtggccagcctcctgtctattaaactctctctctactatacaatgccttggtatttatgcagttggcaggaggaaccccttgggcggttacacttctttgtttttttgttttttgagatggagtcttgctctgtcacccaggctggagtgcagtggctccatctcggctcactgcaagctccgcctcccgggctcacgccattttcctgcctc[223 bp omitted]atagaagtgagatcatgcagtacctgtctttctgtgcctggctgatttcactgcacataatccctccaggtttatctgtgttttcatcattgtctattttataatcccagaagacagcctgagagttgatttttgtaaattcctgtactggtaagtggctattggatgttccatttagtttgttttcctccacttgttttcttatctgttggattgaaaccactttgtaaaattatgactaagacagtgcaagagatctaacttaactcactccatcttgcttctaacctccaagctgtccttgttcattcctgggcgcaggctaaactaactttgggagaaacttagcttatagtttattgtttaaacaaagatggtaacagccctttcccaaagcagacctccttcttgcctggggactagattgcctttgtagggctaacattagccagaagattagaaattatggtttgggagttcatgcagctggaggctacaagattctgaccctccctaaactgcccctaagatcagtgcctgagatattttgcagacccttcacttgatggatcagctggcaccacccagatagttaaactggctcttctgatcttgtggcccccacccaagaactgattgaacgcaagaaggcagctctgactccctatgatttcatctctgaccaatcagcactcctgactcactggcttctcccgacccaccaagttatccttaacagctctgctccctgaatgctcggggagactgatttgagtaataataaaactcggatctcccgcacagccagctctgcacgaattactctttctctattgcaattcccgtcttaatgaatcggctctgtctaggtagcaggcaaggtgaaccccttgggtggttgcaggttaagcaaataggtcaggtgattttatgttcattttagctgtagaactttgttctagtctatctgaaaagtttttagacaagaaagtcaagggaggttttcacgatcagtggactcttcctttttttttcaaaaatcgagttggttcaatgagtattatttattgagggaactctttaaaatactgaacattgttaatgactttcacgcgcgtccgtgtgaagagaccaccaaacaggctttgtgtgagcaacaaggctgtttatttcacctgggtgcaggcgggctgagtccgaaaagagagtcagcaaagggagatggggtggggccgttttataggattagggaaggtaatggaaaattacagtcaaagggggtttgttctctggtgggcaggtgtggatctcacaaagtacactctcaagggtggggagaattacaaaggaccttcttaagggtgggggagattacaaagtacatttatcagttagggtggggcaggaacaaatcacaatgttggaatgtcatcagttaaggctgtttttacttcttttgtggatcttcagttactttaggccatctggatgtatacgtgcaagtcacaggggatgcgatggcctggcctgggctcagaggcctgacattcctgccttcttatattaataagacaaataaaacaaaatagtgttgaagtgttggggcagcgaaaatttttggggggtggtatggagagataatgggcgatgtttctcagggctgcttcaagcgggattaggggcggcgtgggagcctagagtgggagagattaagctgaagggaggtcttgtggtaaggggtgatatcatggggatgttagaagaaacatttgtcgtatagaatgattggtgatggcctggatacggttttggatgatttgagaagctaaatggaagatacaaggtccgaataaaaggaggagaaaaatgggtattaaatgtctaagaattgggaggacctaggacatctgattagagagtgcctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagttttttggggcacagtctaagttggtctggtgtctggaatgagactggggcctaataaaaaggagcgtctatacaggagcttaaatgggatgtaccttgtagcattctgaggacaggcctgatttctgagaagggaaagtggtaaaagtattgtccagtcctttttaagctggtggctgagcttggtgaggtgtgtttttaaaagacctttagtccgttctacttttcttgaagaaggaggaccgtaagggatataaaggtttcactgaatactaagagcctgaaaaactgcttggctgatttgactaataaaggctggtctgttatcagactgtatagaggtgggaaggctaaactgaggaattgtgtctgacagaagggaagaaatgactgtggtggccttctcagaccctgtaggaaaggcctttactttattcagtgaaagtgtctatttagactaagaggtattttagtttcctgaatcagggcatgttgagtaaaggtaatttgccagtcctgggtggggcaaatcctccagcctgatgtgtagggaagggagggggcctgaataatccctgaggagtagtagaatagcagatggaacactgagaagttatttccttgaggatagatttccacgatggaaaggaaatgagaggttctgagaggtgggctagtggcttgtactatagcataacctgcctttgctggtgtgtggcgattaggcctggtggaacttccatcaataaatcaagcgtgatcagggtgaggaacaggaaagaaggaaatatggggtgaatatcaggtggatcagagagatacagtcatggaggtcaggtgtggtatcaggaataatgtgggaggccagattgaagtccaggccaggaacaatggtaattgtgggacttaagaaagtgtgagtacagctgaaggagccggggagcagaaagtatatgcgtcaggtatgaggaagaaaatagattttggaagttatgagaaatgtagagagtgagttgagcatagtttgtgattttgagggcctctaacagtattaaagcagcggcagcggctgcacacagacatgatggctaggctaaaacaggaaggtcaagttgtttggacagaaaggctacagggtgcagtcctggctcttgtgtaagaattctgaccacactaaccatgcctaggaaggaaaggagttgttcttttgtaagggattgaggtttgggagattaatcggacacgatcagcagggagagcacctgtgtttttatgagaattatgctgagataggtaacagatgaggatgaaatttgggcttgactgaagtaatgggggctgtctgtgaagccttgcggcagtacagcccaggtaatttgctgagcctaatgggtgtcagggtcagtctaagtgaaggcaaagagaggctgggatgaagggtgcaaaggaatagtaaagaaagcatgtttgagatccagaacagaataatgggtagtagagggaggtattgaggatagaagagtatacgggtttggcaccacggggtggataggcaaaacatttggttgataaggcgcagattctgaactaacttgtaaggcttgtctggttttaggacaggtaaaatgggggaatggtaaggagagtttataggttttaggagcccatgctgtagcaggcaagtgataacaggctttaatccttttaaagcatgctgtgggatgggatattggtgttgagcggggtaagggtgattaggttttaatgagatggtaaggggtgcatgatcggtcgccaaggagggagtagaggtatcttatacttgtgggttaaggtggggggatacaagaggaggacgcaaaggaggctttggattaggaataagggcggcaatgagatgcagctgtagtccaggagtagtcagggaagcagataatttagttaaagtgtctcggcctaataagggaactgggcaggtggggataactaaaaaggagtgcgtaaaagagtattgtctaagttggcactagagttgggaagttttaagaggtttagaagcctggccgtcaatacccacagcagttatggaggcaagggaaacaggcccttgaaaagtaggtaatgtggagtggggagcctccatattgattaagaaggggacggacttaccctccactgtgagagttacctaaagctcagtgtctgtgatggtctacagggcttccgaggtgattgggcagcgtcagtcttcagccgctaagccgagaagatctgggaaggagtcagtcagagagccttgggccagagttccagggtctctgggagtcgctgccaggtgagttgaacagtctgatttccaatggggtcccgcacagatgggacacggcttaggaggaatcctgggctgcaggcatttcttggcttggtggccagatttctggcacttgtagcaagctcctgtgggaggaggttctggaggaacgcctggctgctgcggttcaggtgtttggaagttcttgtttgctggagatgtggctggggtttgtctcacagtggaggcaaggaattgcaacttttttttttttattattgtacaccttgaaggcgaggttaattaaatcctgttgtggagtttgagggccggaatttaatttttggagttttatttaatatcgggagcagattgggtaataaaatgtatattgagaataagacggccttttgaccttttagggtctagggctgtaaagcgtctcagggttgctgccgaacgagccatgaactgggctgggtttttatatttgatgaaaaagagcctaaacgcttctgatttgggataaagaaaaaggagcattaaccttgactatgtctttagctccagccacctttttaagagtaaattgctgggcaggtgggggagggctagtcacggaacgaaactgtaagccggaccaggtgtgaggaggggaggtgataaaaagattacagggtggaggagtggagcctgaggaagaattgggacctagcttggcgtggagaggaggggagaggtcagatgggtttgtagaaaaggaagattagacacactcagcaacgcctggggttgggactgaggggacaggtgggagggaaagaaggaagatttgggacgagttgcactgggcacagagactaggaagggacggatgtgtaaaagaatgcctggacatcaggcacctcagaccatttgcccattttttgacaaaaattatttaggtcttgtaggatggagaaatcgaaagtgccattttctggccatttagagccattgtcaagtttgtattggggccaagcggtgttgcagaagaaaatgaggcatttaggttttaggtcaggtgtgagttgaagaggttttaagttcttgagcacacaggctaagggagaaggaggaatggaggatggaaggttgcccatagtgaaggaagcaaacccagagaaaagagagcgtaaagacacggagggaaggggtttggggtttcttgccccctagaaaagtgggacttgctgctaagggtgaaggagaaggggttaaggggtacttgcccctgccccaggaaagcaggacttgccactaagggtgaaggagaaggggttggggggtacttgcccctgccccctagaaaagcgggacttaccgctaagggtgaaggagaaggggttgaggggtacttgcccctgccccagaaaagcagagaaggggtagagacaaggagagaaggggttggggtacttgccctgtccccagaaaagcagagaaggagtagagacacggagagaaggggttggggtacttgccctgtccccggaaaagcagagaaggggtagagacacggagagaaggggttggggtacttgccccttccccagaaaagcgggacttgctgctaagggtgaaggaccaaggcagttgtccctgcgtggtctgacacccttgaaacgtgggtgtataatcagagaggcatccctgcaatgattaaacaccaagggaaggctgccttcccagtctgtgaccagcgccggagttttgggtccacggataaaacgtgtctcttttgtctctaccagaaaatgaaaggaattgaaattaagagaagggagagattgaagtgtagtgccaagattgaaaggagaaagtggttgagggatagtgagggaagttggagaagagagtaaaaagaggctgcttaccagatttgaaattggtgagatgtttcttgggctcgtcggtctgaggacctgaggtcgtaggtggatctttctcagggagcaaagagcaggaggacggaggattgatctcccaagggaggtcccccgatccgagtcatggcaccaaatttcatgtgcgtccatgtgaagagaccaccaaacaggctttgtgtgagcaacatggctgtttatttcacctgggtgcaggcgggctgagtccgaaaagagagtcagcaaagggagataggggtggggccgttttataggatttgggaaggtaatggaaaattacagtcaaagggggttgttctctggtgggcaggggtggatctcacaaagtacattctcaagggtggggagaattacaaaggaccttcttaagggtgggggagattacaaagtacattgatcagttagggtggggcaggaacaaatcacaatggtggaatgtcatcagttaaggtggggcagggcatattcacttcttttgtgattcttcagttacttcaggccatctgggcgtatacatgcaagtcacaggggatgcgatggcttggcttgggctcagaggcctgacaatgacctgctctgtatgtcctcatgtaacattattgccaacgaaatagatgctctgaaatacaactactaacttaaactaactctgaaatgtttcatctctgctctgattcatgccataattattttcaaacagagagataagcagaactccgaactgttaaatcccttagaaagcccacagcccagtgcacccttaaagaaagggaaatagagccgggtacagaggctcatgcctgtaatcccagcactttgagaggccgaggcgggaggatcacgagatcaagagatcgagaccattctggccaacatggtgaaacccccgtctctgctgaaaatacaacaattagctgggtgtggtggcacgtgcctgcagtcccagctacttgggaggctgaggcaggagaatcgctggaatccaggaggcagaggaggtagcagtgagccgagatcgcgccactgcactccagcctggcgacagagcgagactccgtcaaaaaaaaaaaagggaaataggatctgatgaaagtgtgtattggccccacatcaagcagctataattcacagaagtaatgctagaaatgttgctgcctggcttttagcccagcgaggtttccaaacctctctttaattacaacagacctacctcaacattcggccatgtaatctgtagctcaaatgtcaacatcattctcagctaagccatgcagtagagaaaggctcaattatgtttctaagcttggctgcaccttagaatcacttggaagctttggagaaagaaatgcctctgagtcccactatcagagacttacttaagtgttttgaaatgcacctgcggaaatgtgaaattttaaaggtttcaggtgatgctaatatgcaggtaagtccaagaactctacgtattcctagaaatgtgcgttccgtggtcacccatgatgcttttcgcatgggctatcactatttttatgcgtgcatcgagcatgatactttatgtaagcgcgggacatgttaatatgcattgtaaaaagttgccttgctaatgttcaatgcacatttgcataacctcttagtgccatcttcatggggcatgccatatcagacaatggccagcaggtggcgatgttgatttgagttgctgagaagtgaaattttccttaaaaatctggcatcttcaagtgaccccctcaagggctttgctttgttttaactacacctgccaacacctggagagggtcaattgtgcataatgagcgttcatatggaggtgccgaaaccacaactttgtcatggtatttgttcaaaccatgcaaatgcttcaatcatctctatttgttcaatgtttagggtgccatgaaaacataaatatctaaatgcagtctttccagacagatatttggtgatgggcattgattccagaaaaggggcattctccgaaaagatgctgaggaggagagcaaatatagcttttgtgaagaaatgtttacccgggtgggacaaagagaagcacaattgaggctggaagttgaatccagctgaaaagagatgcatttagcctaattaagttaatggacccttcactgaattgaacagaatttttagttcctgtacattaaaaaaatggaacaccaccaaaaaaaaaaaaaaaagatgggagaaaagaattagattttcacccatcagagatgaatttgaaatgctaatatgaccaggttagaactaggaaaaagacataactgggaatatttttggagcattcacttagttcccagattcagtgaagtggttatagacagcattgtaaatcgtattggctggatttttcttccacacataacagtacaggcattagactattaattaagtaactcgttcattcattgaagctagatcgagcacctactgtgtggtaaagactgcatactgtgtagccctatggagactaaaggagattactttcagttctttctgtaagttgttcttccacctccggtgctagatctaaggtcacctacccatcagcttggtctctatccccttctccatgttaataaatattcctgacatataataaatttatggacagaaactacaacttcactcagactaattattttaaaggatatgtctatctttaaaaaacgcatttgaacattttactgaaagccagcaatttaaacttagtgtttaaacagatcaacttgaagcccttctttacaaaataaaaagtttagccttctagcttaaacttaggatgtagaaagcttgtaagaagatcatcgctccaacaatcacggcaaaatcaaggacacatcataaactaaatctaaagtttcttgaatctgtcagaaaactccagttttagggtatggtgggtaatattaggtgtcaactattgagggacgcctagacagctgataaagtattgtttctgggtgtgtctgtgagggtgttgccagaggagattgacattgagtcggtggggtgggagaggaagacccaccctcagtgtggatgggcaccatctaattggctaccagtgtggctaaagcaaagcagatggttagaaggtgggagaagctggcttgctgggtcttctggctttcatctctctcccatgttggatgcttcactctgttcctcctgcccttggacatgagactccaggttctttggcttttggactcttatttatttattatttattatttattattattattattattatttgagatagggtctcactccatcgcccaggctggagtgcagtggtgtgatcttggctcactacaacctctgccttctgggttcaagcaattctcctgactcagcctcccaagtaactgggattacaggcacccaccactacaccagactaatttttgtatttttaatagagacagggtttcatcatgttggccaggctggtcttgaactctgggctctgacctcaagcaatccacctgccttggcctcccaaagtgctgggattacaggtgtaagccaccgtgcctggctggtttttggactcttgtacttacaccagtggtttgccgggggctcttgggcctttggccacagactgaaggctgaactgtcagtttctctgcttttgaagctgttggacttggaataagccactaccagtttctgtctttcccagcttgcagatggcctatggtggggtgtcaccttgtgatggtgtgagccaattctccctaataaactccctttcatatagacatagaacctattagttctttccctctggggaaccctgacgaatatatagtgcaaacaatcaggctgaaatacaaggaaaggcaggcgtttctaaggtgagatgggatgtgtgtacatcttaccttgaacagacacagaaaacacacaaatggataagacacatgtggagaaagtcttaaagggcttgctgaggctgacagtggactagcataaagttgtaggacctctgggagatgcagccacaagaggaatttgcagctgtcaccgagtcttcacaaactttacctgttacctactaggaagactggggacaagttgagggaactgaaaaagcccccaagatgatgtcttgggagagttgaacagtagtggcagagactcttctccatgagtctcttgtcctccatatcttatgggtgtgctaagtaagaatgccaggtgctgaccactctttccctagagtatttctcagggttgtggctctactacatgttcgaccttgaaggagcaggtgacatcttcctccaggacaaagagcaggctctgcttatcgggggttatgaagtggccgacttttcccaggctctgtatctccctcctataaggcagcccatagcaggtgtaggttcccatccaagttcatcctcagcacccccttgtggtcctgagaaaaagaagctgatgctctggcaatggctttgctggaaacaagtctctagtcttagacctaaaagttctgtgtcttctgccagcatccatagaatggcagcattgcagcaagctattttattaacttgcaaacaggatatactcccagactcttcatagttcttgatgggaagtcactcctggtttgcagtttgcaggtggaacaaaagtcttcagttgcaggaaatcctgtgcagctgaagatcctctgtagccttaagaaaataataataatagttttattatgtgttatactatatataatgagtattatatacaatatacacagctgaccctggaacaacatgagtttaaactatggggatccacttatcagtggatttcagtaggctgctagctaagttttggtggaattaaaagctatatgtgaactatttttgagacggagtctcactctgtcacccaggctggagtgcagtggcacagtctcagctcactgcaacctccccctcccgggatcaagtgattttcctgcctcagcatcctgagtaagctgggactacaggcatacaccaccatgcctgactaatttttgtattgttagtagagatgggtttcaccatgttgccca[131 bp omitted]agcctcgccctgttcaagggtcaactgtacacaatcatataatatgaatataattgtatataattcattgtgtatactatatatagttatacatatattatgtacaattttataccttatattctatattatgtcatgtataatatatttaaatatataatatataatatatattttataacattaattagcaatattttttgtttttaatataatatagtatgttatatatatctatatctatctataaaatctaccatgtatctatgtatcttctatcatctatcatctatcatttatctatgtctcatgtatctattacctatgtatgtatgtatgtatgtatgtatctatctatctatctatctatctatctatttattatctatctatccctctatgctggtgaggggatgagaagggcactttacctctgtggtatttgttcccaacattccctaaccccactctaatgataagacaaacaggagacaaatgtggcatgggaaatattccacagactacttgaacagtactcaagactgtcatgaaaaagcaagggaagtctgagaaagggccacagacaggacatgggggaggggtgacaagtaagtgcagtgtgatccctcaatgggatcctgagacagaaaaaaaaaaaaagttcataaaaagccggtggaatctgaccaaaggtctgaagtgtacttaggagtgctgtgtcaatgatgtcggattcttagttttgacaagtacagcacagccacattagatgttaataatgagaggaactgcttgagagttgcacagggacttcctgtactccatggcaatcattcaatcaagcccatttaaaaaattccgttttaagaaatgcacagtctggtacaccaaaccaacaatccaattaaaaaattggcaagttgtttgaatagagactttaccaaagatgttacagaatataggctcatgaaaagatgctcaacatctttagtccataaggaaatgcaaattactaccacagggaaatgttaccacgcatgagtgtgaatgtctaaaatttaaatcaacatacaagaacaaaaatactaaaacaaaaccctaatgatatgaagcgtcagtgaggagggggaatagcagagaaccctcatatgttgttggtgggaacgcagaatggtacaagcacaggaaaacagagcggtggcttcttacaaaactaaatatgcaagtactactgaaacaggagagttccctgacctaccctgcaggacgtgtaacaggggtgtggcatgtctgtcctgctgccttggctcaaaccccttgtggaaggggaatcacacagacaggcagacgcaggagctggagcaagtgcttttgggctctgactccatggtagcttctaggggtgggtgcctgcaactcctgaagtcccagtgggtgtgttacagtgctcttttagctctgccatccacagaccacttaagtgttaaccagctcagtgccctcttggtacccaggttcttgtctggcatctaggaaaaatcaggacacacagacaaactgaagaatagtaaatgcaggggattttattgccagatggaggtggctatcagtgagatggatgaggagctggaaagcggatggagtgggaagataatcttcccctggagtttggctgttacatggctgatgtcctctctgaccatccccagccaaactcctctcaatgttcaaatgctccttctcttctcttcttctctccttctctgctgcgctgttcttctgctcctctgctcttctgctcatagagcctggggtttggggtttatatgggtacaaaataggggggtgttgtgggccaaaaggcaacatttgggtgtgaaaataggaatacctgtttccatttagggccatgggtttccaggcttgaggatgtggcttttgccagggaaccaccctcttctacacagtatttccctgcctcctgtccatatcactacccgacccaatatgacccagaaatcccctcctaagtgttgccaaagagaaataaaacattagtgtcggttaaaaaaatacctgtcattgagtattcattgtggctttaattgtaatcatgaaaaaatggaaacaacacagatgttctttaatggatttgaggattaaataaaacaaaacaaaactggagtatatgtatagaatgaaataccatccagcaatacaaaaggaactaattgctgatatatgcaacaatgggggaacctcaactgtattaacctatgtgaaacaagccaatgtcaatagggtgcgtattgcattacccatttataaaatattctggataatgcactatatggagagattagtggttagattagtggtaccggtgggctgaggtgatagcaaggggttattgtcaaaaggtcaaagcatgatgtgtaggttgagacactactttatgcatgggttatattgtcaatatgcttactatttttatcaaaacttgccaaacctacaataaaaagagtgagttttactttagataccagataaccacaattatttttaaaatcatcattatgagaacacccacaaatatatgaaacatataggaggtgccaggcttggggaaacaaaatttagaagatttggttctcacaattccctctgtgagttagaaaccacgatttatcttcagcatagaagagaaaaccaaagctcataatgggttgaccacacgtcctcggtcacacaacagagaatgctcaaatgcagattggattagctccaaagtccatacctttctgagtatctctctgcagttcttactttccagcacaatcataaagctttgggggaaaatatggaaagcagagagttcaaagggtagtgagacaggggcacacataataaatttgttactaaaaagaataattagtcatatctctttgacattacatggggctgtaagactgtcagtgctcttgataataaaaaatgtattgaaagacttgatgggaatgaaaatgcctcagatgaaacatatagttttgttttatttattttttattgtcgatttttgtgggcacatagtaggtttatctatatatgggttacataagatgggttacataagatatgggttacataagatacaggctttcaatgtgtaataacgacatcagggcaaacgggggaccgtcccctcaagtatttatcatttgtgtccagtcatttgcaacaacatggacagaagtgaaggtcattatgctaagtgaactaagccagacacagaaaggcaaactttgcatgttctcatttatgtgtgggagctgaaaatcaaaacaattgaactatggagatagagagtagaaagatggttaccagagcctgggaagggtagttggggggttggttaatgggtacaaaaaaatagttagaaataatgaaacctatagttttgaatggactttatatggcctttcagctaacagacgctaaacgtatcatttatatggcctttcagcgagccgaccataaacttaacatttcagaagacaatgtgcaccttgaagggttatgtgaaccctaccctcaacctctccagtttttagactgtatctaatttacctccttctccaaggatattagtttttagatacctgtttaagtatgttgtttgtagagtactgaaaaaggccgtttcatggtaaatgttttccatggttttcgaggtttagtggcaggatctctttccatttgattaatatttttctacctgttgggatgaccatggaatagctatggattgaggctgaaagaagaacttgtgactcaaaagacagaaagatacacaagccctggtatcttggtattccaggagtagcagttaggtgaatttagaggaataacgagaggttgtgccttttgtaaactgacattcctgagatgagtgggaattgtccactctagggaccccagtctttacagtcttacttaaaaaaatcaacaatcctggctttttagctgatggaaaaaaaaaaaaaaagagagagctagttttctggtatccaaactacagctccccaaatgatggagtaggtttagaatatgcttataatattctttcaacaatagaattacaattacagcaggacagtcttcatttagagtcccattccagagctcttttccccttggtttttcatttacatcagattctaatattaaacatactttcaatttgtgattcaacaggactcagatgcaaatacagttctctcagtaatcagcattacgggatttggtttcttacaaagaagctaatacttacgtaaaggtggctgaagaataattttttcaaaaacctcactgaaaaaaaagtggttaaggccccagtagaattcaaattcaggattaagtcaaacagctgaaacacactcatacatgcagaaattgttgaatcagattcacttaaacctgaaagaattcaaaaaaggtctttctaacgttctaaagttagtgctccaaattaaccctccatacatataattagtaaaactgatgcatcatgccattagttaacatttgtgcattttattgtttatgaactatactttaatggcaaacaaactgaaataacattacaaagtgtgctgtttcttcataatcaaaccttttcctgcatctccgttggcattttgtggtatgacagtcgttttaaaaataccactaaatttgggacttctaatatcactttggtcacgtacctgtggttgtttaaattattcttgtacgcaatctgcaatattacattttttaatatgattacggtttttgtgcctgagccttttcatacaataaattgttttgtttgtttgtttgagacagagtcttattctgtcacccaggctggagggcagtgcacaatcttggctcactgcaacctccacatcctgggttcaagcaattctcctgcctc[132 bp omitted]tggcctcacaaagtgctgggattacaggcgtgagccacagtgcctggcaggggtttttttgtttgtttgtttttgtttttgtttttgtttttacaccatgattatctttctcctttgtagagtccctttggagactcaggtttcagagaaaactactaacaatgatgtattagaaacaaacttttgcaactttgctgcgcctcctcagagtaaatgctatgggaccatgtattatatcttctccagcagataaagcgaagtgttttggtcagcttagagtaaaactcaagcagtaatgctaacacataatatgttgtgatgtaataaagagagatgacataataaataccaggcatgtgattggatgatctagtgtcaaacatagtataccctacagcattaggatttgtgtccttcttttttaacttttaagttcaggggtacatgtgcaaaacctgcaggtttgttacagaagtaaacatgtgtcatgggggtttgttgtacagatttttttaattactcaggtattaagcctagtatccattagttatttctcctgatcctctccctgctcccaccctccactttctgaaaggccccagtgtgtattgttcccctctatatgtccatgtgttctcatcatttagctcctatttaagtgagaacatgtggtatttggttttttgctcctgcattagttggcaaaggataatggcctccagctccatccatgtccctgcaaaggacatgatctcattctttattaaggctgcatagtattctacattggatatgcaccacattttctttatccagcctatcattgatgaacatttaggttgtgtcttgttataatgactcctcatggtttccagagaaggttagatgatagatgaaaaatcctacttgatttgaccagcatttatggagagccttcaacaagaatcaggtgcctacctagtctagtacattttttccccagaaccttgatgaagtctgagatgttgtccacattttgcacaacttgggtttccagaattaacaaacttattaacagttgggtcttctattgctatctcttattctgcctctattcatcaccacacatgcttaggttaacttgaaagtgagagaggacgtggcccaaattgtggtctttctccagaatattttgttgttgttgttttccaattttgaatattttctgcaaccacactttgtcattgaaattcctgtggtttctccggccccctgcccatcagtcaacaagtggataaataaactgtggtatatatatgatggaatactactcaaccataaaaaggaatggattaatgacatttgcagcaacctggatgggattggagaccattattctaagtgaagtaactcaggaatggaaaaccaaacatcatatattcttacttataagtgggagctcagctatgaggatgcaaaggcataaggatgacacaatggacttcagggactcaggagagaaagggtgggaatggggtgagggataaaagactttgggttcagtgtatactgctcaggtgatgggggcactaaaatctcacaaatgaccactaaagaactgactcatgtcaccaaaaaataccacctgttccccaaaaacctatggaaatgaaaaattttaaaaaggaaaaggaaagcttgaggtttcaagctgtcacatgctggtagatttcattcttaactcattgtcctgttcctctaatgcttacctgctatggatacatgtttgtatgttttaaaatacttgtaagtacaggaaaaatgaaacaagaatgatgaaattccggtagccaccatctagaattaataaatgtaaatattaactttctgtttagatatttatatttaaaaaatgggatacaggaagtatccctttaaccttatgctaaatctttctccctccttcaccagaaaaccattttcatgaatcagtcttgtatcattccaatacaatgagaacactttcaaaatactcatacatggaaccattaatcatagataatcatagatagaattcctctttttttttacattcaactgaatctatattctgcttacagcattttcacgcaacattaaatcatatataatagctctagttcattcacttcaactgctgagataatttttttctccttttttattacatatatgactattaatttggtcatttcatgtttttaatataacatgatgcttttcttcagttttcttttctgttcctctttttttttttatgccatctcttagattgataatgtttatcagcctttttttcccttttattggtttggaatttcactttcatttttaatcatttcatctttaatggttaattctgcaatgttaacatgtatatataaaaatatatgtattaatcaatatccctaattttctcctgaaaaacaagagtcttaaaacatgttaaacatcatcttcatcttctatcttccatgcagcatttttcagtattttaaatctacctttttacatactccacaaaattaaacttttgtatttactactatgcctataaaaaaaattagaaagacctagtatttgatagcataacagggagactacagtcaataatgattaatggtacatttaaaaataaaagaggctgggcatggtggttcatgccagtaatcccagcaatttgggaggcccaagtgggcagatcacctgaggtcaggagttcgagaccagcctggccaacatggcgaaaccccatctctactaaaaatacaaaaattaaataagcatgatggtgggctcctataatcccagctacttgggaggctgaggcaggataattgcttgaacctgggaggtggaggttgcagtgagcaaagatcacactgcactccagcttgggcgacagagcaagactctgtctcaaaataaataataaataataaaataaataagggagtataattgagttgttggtaacacaaaagatcaatgcctgagggttggatatccaattttccatgatgtgattattacatattgcatgcctgtaccaaaatatctcatgtccacaccataaaatatatactcctactatgtacccacgaaaattaaaaataaaatttttaaatgtacatttacaactgcagttactagtctgtggcttaatattgcttcttacatcacaacttactttatgcatccaattgtcatgtttttgaagcatattttctagaaattatttctattagagtcatattagcagcacattatctgcatgcttggatgtctaaacatattttcttgggtcctgaatcttgaatgctatttaaatgtggtttaaaattctttgttaacatttatttctatgcaactttttaaagatacctacatgttctgtagtcttgcattgactggagttacgtgtattttcatttctttacatataattggccttttcatttcaaagcttcacctccgtcttataatttagagtattattttctcttctattccgacccttggaattactctttcttgcttttgaggtcagtgatggcttaaacgtttcttttcccctcggtgttccttagtttttgcagctgcgcagggattcccgcatcagtcagacaggagtgatacaactctagcttaaccgaggctctgatttgttttctttttgtttagacttcatgaaccttaatttgtgcctgcctatgctgacttttctttagcagctgctgtgataaaaaataaataaatagataaaaaaggttcacaaagtcaagacaatctaggtcactgctctcgaggaatgtatagtatactcagatacactgataattacatacgtgtttttgacacagtgcaatcgtttctaccacagtgtatagggagtgcattaagacagataaacatctacctacctaatacctgtggaagaaaaggcaaagcatgtactcttgaaagacagtggaacgcagtagctcagggtgctgttactggaggaagtgaggctagcgttcggcctctggacaggccacttatttgcacaagttcctcgagctctctgagtctccattttcttgcattggtacacagatggcaactgcgtgtgccaagtgatctccttcccgcggtaaagtagataatgccccggagacattgtctgacacataggaagtgcttgctacaacttagcaattgtgatgtttcaagggagtgatatttgctctcagtggtgcagtagggacagcagtgagcaaatggaagtaggttgatctgtggagatggacaagcacatagaagtgtgcagcaatgttgggtgtggtaggcagagaggcagaggaacttctgtttgcttcagtaatatttgttctatttgcacattcacatcctattctctaaagcctagggcagtcaagcctataaactgcaaataatagcatcattctactgcaaatactagtgttataatattatatattcatgttctgatttatttgcaattgccatggcaattgttaagtgtcctaaaatataataagggagcgacatttgcattggagaggttagattatattcaggggcaaaaatgtaaaatgtaactttcaaatgtccactctattgtgtgtccacaaacacacacacacacacacacacccctttacagagatagtccaaggtaaggagtacaatttctcatataagggaaatcaaaatacattcttgtatcttcatgatattttttccagatgtgacctggctgggacaaatctctgtaagattaatagttccctggaacacaactaataaaaattggaatttctcaagactttcccatattattcatttatttttaatttgacaaataaaaattatatgtatatttagggtgtaccatgtgatctaaataatttgaaagaatctagctggtgctttaattctttcagaaactgaaaattacatacatctcaaaatatgatttttatactaagggatgaaaaggagttggcatgtgaaatgcgtgcttatgggattcttccataatgttgtgttttaaaggtggtgctatttgctggggcacttcaaaccaagcctcgttcttataattaaatgcctgggatggtgcttttccagacctctttgaaatatgtattcattgtggaatggctaaatcaagctacttaacataggcattacatcacatacttttcatttatttaaggtgagaacacttaaaatccacgattgtagccattttcaagtgtacaatatgttgtttttagctacaacatgttgtacaatagatttcctgaatttattccttctgttttaactaaaagtttacgtttttgaacaacatctccccaatcccccaaccacctccaacccctggtaggtaaccatcactctactctctgcttctatacgtttgacttattttatttctaggtataaatgagattatgcggtatttgtctttgtgtgcctggcttatttcacttaacataatgtgttctgggtccatccatgttgctgcaagtaacaggatttcattctttttaaggctaagtagtattccatcgtgtatgcataacacaatgtctttattaattcatccatttatggacacttgggttgattccatatcttggctattagcaatagtgctgcgataaacatgggggtgcagataactcttcacctaggtatttttcatagagtaaaatttcaattaaggctatttatcaaatattgaaactgagatgatacaattgcttaagtaaaaattggataggtttctgggaagatggcgtggtagtaactgcatagttttcatctattgccaaattcccacacaaaaacagacagagtaactagaaatcatacccccaaattcatagacaatatggccagcaaaatagatgccagggtatctcagaaccacaaacacattagactcagtccatgccaccagcagcccccttgtatgatatcagctgtagctatctctgtgaaaaaaattgaggtggtgctttaattcttcaagaaattgaaaatcacatacatctcaaaatatgatttttatattaagggatgaagaagaggagttggcatatgaaatgggtgcttatttgatttttccattattgttgtgttttaaaggttgtgctgcttgctggggcacttcaaaccaaggctcattcttataattagatatctggggttatgatttttcacatctctttatttgatgctttgcctactagagccagctctggaaacatccagcttttagtctttggatgaacttatcgatttttgaaaatacaattttacaatgtaagttttgaaactgtgacatatatatgtgcgtgtgtgtgtgtgtctgcatgtgtgtatgtgtgtgtgtgaacacacactatatatatctcatatattcagattttaactgtcagtctaggcctctatacataaaataaaacatgtatgatgtgtcccatggggctaatttatataaaacaattgtgaaatacatgagcagaaccagtcggttttctttgagagggatctcgtagatctattccatagaataaagatctaacactcctaaatgataaattgctaggtactcctgaggaattaatatgaaatgaatcagaatttatttttgccaggcatttcttttgtagagtcattaatccagctaaaatgaaaatatttgctacattgataaagtgtttatgaagaacctccaggtatccatatacctatgtacatccaatgaaaaactctaccagtaattagcagaaggccccccacacacatttgctctgtaacagtaatttttttttaatttgcttaactaattggaaagaccagtttctgaaacttatcaagaatagtaagaaaagtgtcctactcagtaaaattcattgacctaactcacccattagaggactaatgtaattattttagtggaaaaacagtcacctgattggtaagtacgataaattgtgaagacgatgtttttattaggtatagactctggtattttcttagaccatttgggttgctatagcaaaacaccaaagatactgggcaggttataaacaacagacatttattgcccacaattctggagtctggaagtccaatatcaaggtgtgacagattcaatgtctggtggcgacccacttcctggttcatagacagtgccttctcgctgtgtcctcacacagtggaaggggcaagggagctctctggcaaaaccccacctctacaaaaaacacaaaaattagtcggtcatggtggcatacgcctgtagtcccagtgacttgaaaggctgggatgggaggatttcttgaacccagaagatggaggctgcagtgagccatgatcctgccactgtactccagactgggtgacagtaagatcctgtctcaaaaaaaaaaaaaaaaaaagaaagagagagagagaaagaaagaaaagaaagaacttccattgctaaagatgtatatgcttataaggttgagacaaagcgaatctgtccttcccaatgacatttcagggtatttgttcacaggacagaacatattagggattgatactggctagaaatttctgttgagtatttattaccccatggtaataattgtaaaccacaatttataaggttttttttgaaagccacatcattttccaaagagataattggaagatggaaatcgagggtcaaagaatgaaatgcagctaagatttctgagaatttctgaaagttgtacaacatgccctatggctactcttctggagccttcagaggatatgtggccctgagacaccttgatctcagacttctggtctccaggactgggagagaatttatttctgttgtttcaagctcccagtttgttgtactttcttatgacagccacatacacatagcttatgttctttaacctctacatagaattaataaaggagaaacagtaagttcgaagttatgactacatgataatttctcactggttttccaggtggtacactcaagacacccaggctgttccctggagaaccctctgccattttcttcatcctaattcgattctcctctctctctgctatgttaaatgcattttctctgtgaagatgggttcttttctgaggcctctccagatgttctaccagaaaaaaaaaaattgtaattggaccagagtttcttggttgccatgtttcccaggctggtcttgaactcctgggctcaagtgatctgccagcctcagcctcccaaagtgctgggattacagggtgtgagctaccgcacctggccagagttattcttaaattttgacccatagtaagaaataggaaatactcttaaaggccattgattttcagtgatattgccggaattcatggaccttttggttagaactacatgcttttttctgtctgaagcaataaaattctataaatctaaatatgttttcaaacattggtgggaaattagagatgcaataactcctacaaaccgtgcatggcaaagatgtacaccacaacaatttggaacagacagagcagaattgatccaatcctattggtagtcgatacagcaagcttgcattttttagaactaactttttcatagttgcaggcagagtgatgaaagattttggcagccagtctcttcatatagacaccaggagctgaaccgactagtgtgaattgacacataaactaagagaagatgaaggacatggtcaatatgcaacaaaatgctctaaccaaaaaatatcctgcacaagcttggagcaagaaggatcacttttaacagcttctcaatctcagcactaataggtggataatcccaaggcctcctggtgttagtgttacctttttttttttttttttcttttttcttgagacggagtctcgctctgtcacccaggctggagtgcaatggcgccatctcggctcactgcaacctccacctcccgggttcaagcaattctcctacctcagcctcccgagtagctggaattacaggcaccctccatcatgcctggctaagttttgtatttttgtaga[139 bp omitted]agagttacatgctttcttgcaaggctacccaaagagttattttatatcactcaaacaaaagtccatggtaacacaccatttctaaattgttaaagagagggctttaaccagatcttctaggttgatgaattaaatggggtagggagaagagaagagctttttaactgtgttttaaaaaattgttgtagatactctttaacattttatgaaatctgatttttgtcaagatctgacaataataaacttgataatgaaaaatcttcatgcaccctgaaagtaagcaaaatgaaaaatcctgtaagcccaactccctcactacaccgggaaacttgtctcttcgttagaaatctccactttggaaagctgagctctgcaacgctctgacatgggggattcttactgtggttatccaagtctcagaacctgagacttcttaccatttactgtctgtttgcagcctgagatgaactcttcttcttccctagagacaatgttatgggctgggaaactacaagtcagacagagttcctagcaaatcatctgctttgtttttctttctattttattttcatttctttctattttacaaagtgcaccactctgacagtataccttatgcatgtgtcatcccctaagctgtgctggttgaatctaaagggtaaaattggcttattatttaaaggaaaaaaatgcatgaattgttgaaatgcatggaagggcagtttgccatcgtttggcattctacactttgcagaccttggcatatttcttggtagctagttggacgctgaacactcaaccagactttttggaaaacaaagttcacagaatatacacctgttcagccccagtctattctctttggaggatggcatccctgtagtttttaaatatcacacaaccatttgcaattcttctagcttccaaaggaggaaacaaagcaacctctggctgcagaggactcaagtataggcagccgatgtggaaagaattttggcaaccgatggtagttctccacatgttaatgatttccattgctgttgtggatctcagtgttgtttaattttaaaatgcacaaaattgtgattacactatgtgaaaccaagcaccgtcctgtgttagaattcaactttgtggcagatgagtcattcaatttacgccagaacaaaattcacatcatcaagggagggagagaaggaggaaagaaggagggaaggtgggagtgaggaaggaaagagggagagtgggagggaggaagaaaagaaacaaagacaaaatttttcttaaatagacgaagtaatatccaggaatagtgaagtaatcttaggttctatactgaaaatcaaaattcaaatggtatggcagtatcctagctagtagaaatgttctgaaatcagaaagagtctgatattaatagatttctgtgtgcattcaacaccacttatttaaagtttaggtttgtgatcatgactggcttctattgagggtagctgtatattttgggggatatactgaaaaataagaatatacaaaaataagaaaatccacagtgaaaatagtacatccttgatttttgttttgttttgttttatttcttaccttgctacaggtcttcaacatcctttattttagagcccagtctctactttttgaagtcttcttctctcacttctaaatttgtatctctcatctcagccctgcaagtggtctcccgtgatctccaaaaccctttggtattaaactttaattctaaacttgcttacattggtaaaacaagctaatgaattcttgttgaaatgagttggatacttacaaaggaatttttattaggaggttttataacaagatctacaaatcacttaatatgggtcatttactgagatcagaaatggccctataatatggaaatggatcttctaatgatatccattccaatgatgctgagtgtcatattttacttctagataatacctctcattgggatatattttacttgctttatgaatataaaatgaggaggctctggtgcaagagcatgaacttttaaacttcgcagactaagtgtaattctgattctgtagatggtaacactgttaacagtaattctctgagcttcaattgccccatctgtaaggaaggtgatgacgctagttacctcatacaaatcatgtgaaagttacaaatttttattttcctgtagggtttcgttttcctgccacttcttgagagatagcgatcatcatgtggtatatgtataaatacctgtagacaacatgtggacaatctgatgtgtttcttcaataacactatatggtacttatatgctatataatgtagcttgagggtggatcacagtacatgcagatcagtattataattctgtgtgtcatgctttataaatgatcataactatacaatggtttgtttagccatctccctactaacagacttgaggttgtctataatattttgttattatacacatacacaaagccctaacataaaggtagattttgcactggttatttgcaataatcaattgttttttatggtgataattaagtaatactttaattattttttaatttcaattactaattgctggtgaatagaaaagcaattgaatatttacactgactttgtattctgtcattttgctgtgatcacttattacttccaggagtttttgttgtagttgtttattctttgggatttcccacagagacaatcatattatctatgaggaaaaagacaattttatatcttctttaccaatctatataatttgtatctctttttcttgtcttattgcataacctagaacctccatcacaatttgaactaggaatagtgagaggagacatccgtgtcttgttcttgatcttagggccaaaatattcagtttctcctaattaagtaggatattagctttaggatgtgtggagatattcttcataaaatcaaggaattaaggactctactcctaacttgctcagagttttttgtttgtttgtttttcatgaagtggtactgaattatagcaaatgctttttctgctttaatttatataatctgatgacttttcttctttagcttgctgattacattaattggtttgcaaatgtgaaccagccttgcatagataggatatacctcactttgtcattgtgtatatatattttcacatatggtagaaatctatttgataatacttatgtttataatttttgcatctatgtttataagagacattgggctgtagttttagttttgtgcattatctttatctggttaatcttgtagaattctatttgctattacctatgttaagaatttttgcatttatgcttatgagagacgttggcctgtagtttttcttttgtgcaatgtctttatctggttttgttattaggatcacacttgccacatagcatgacataaaaaaggttccctttgctcttatttcatagaaaagatttaggaaattggggttgtttcttatgagctggattgccaccctgcagtcttcatatgttgaaatcctgacacacagtacctcagaatgtgaccttacttgaagataaagcccttaaagaggccataagctaaaatgaggtcagtgggatggggcccttatccattatgtctagtgtcctaatgaaagagacatcagggtgtttgcacacagagaaaagatgatgtgaggacacagggagaagacagacatctacaagaaagcagagagttctcagaagaaaccaaacctgtagacactttaatcttagacttctagtgttcagaattgtgaaaaaataaaattgtgttatttaaggcacgcattttgtggcatttcatatggcaacccaagcagactactacatgtttattctttagaggtttggtagaattctgtagttaaactaggtggtcctggtacatttttggaaaagacattaccaattcaatttctttacagatataagcctgttcaaacgatatatttgtctttgtatgagttctagcgattggtgtctttcaggaattttgttcttttcattgaaattatcaaatttgtgggcataaagttatttataatattcttttattacattttcctgtccgtggaatcattgatgataacctgtctttcatatgtgatattactagagtgtgtcttttctctttttgcttggatagtatacctagaagttttaaaattttactgatctttttaaataacctttttttggttgctgatttttttctgtgggctgttctaaaatttattgttatatgctttgatttatttccttcttcttgctctaaatttttaaaatgtatctctttttctatactttgccaaggtggaagcttagattattgattttagatctttcttctttaatatatgcatttattgttttaaaatttcatttgcactccacatgtttcaataagttgtattttttattttcattgaattcaaaatatttaaaacattttcttcagactttttctttggcccatgtgttattcaagagagtattatttcatttccagatattttgggaatagtcatctatctttctgttattgatttctagtttagttatattgtaggctgagaatatactttgttttgttacaatctcactaatgtaccacaaggtagcagtctctcattgtttgaagtatcacctggggttctttgtctaatgaccaagaaaattaaggagtgtggacacaaagagtgaggtgggagcaaaagtttaataaccaaaagaggaaagccctctgtagtggagaggggcctgaaagaaggttgccaactatgaggctgagtctggggtttttatggacttggatggggaagaatgtgctgactgggctgcaggctgttttggagaaagcaccatgtagaaagaggtatgagagtgtaaataaccaactggagacagaagtgaagacttggcccaggatcttggaccaggaccaatcagcagctgaagtgatgattcaccctatgtaaatgaagacttagcttgcagccaattatagaaagataggcatatgtaaaatgggtgaaaggtaagagcctaaggcatgccaaggagaaagaaatgtgccagaaaggggtggaatttgttcatctgggttcacagagtaagcatttccattcaaggacgcaagctctttcttatctggggcctgcagtttgattttcaggatcttctttgtttgaaggagctttatcaagaacctaccctaactgcctgtgtgaccagttttttactttctcctctgttagtttgatttctattcttatgaatgtttaagttgtgttttattgcccagaatgttttctgtattggtgagtattccatgtgaacctgagaagaatgtatattctgctattgttgtatgacttattctataaatgtgagtcaaatcaagttaattgatagagctgatcagttcaactatatcttttctgatatttttgctgtttcatctgctagttactgacagggggatttgaaatgtataactagattagtggattattccgtttctccattcagtcctatcagttcttacctcatgcaattttatgctcctgtttttggcaaatacatatttggaattgatatgttttcttgaagaattgtcctctttgatattatagaatgtgcactttaatccattataattttccttgttttgaagtctgatttgtatgaaactcattagatactccagatttgttttgattagtgtttgcatggcatatctctccatctctttgtttttaacatatctgtgtttttaaattcaaaatgagttttctttagaaatgtatattgggagtttttttttttcctttaaatctaccattataatcacatccttttaattgaagtacatacacatgagtctttaaagtgattagtaatatacttggatgaatttctaacatgcttgtaatccttctatttattatatttgttgtttgttttttcccccatttttggctgtctatgcttttttgttgggtatttttaaaaattatttttattttttgtgtgtacatagaagatgtatatattttggggatacatgggatattttgagcagtttaagcaatattatttgtcccttctcttggcatataaattacactttaaaacaacttagtattttcctgaggattacttatttatctttgcagctaatataagtcacgttttgaataccatgatactgcttcctggacaatggagctgcctcttaagagagtattcttaattccaccctcccattccttatgtaattactgccatgcatttattttattgacatatatgctattatctcttaatacattgctattatggttacttgaaatttccatctgtccagccatatgcagaagattgaaactgaaccccttccttacaccatataaaaaaatcaactcaagatggattaaagacttaaatgtaagacccaaaactgtacaaactctggaagacaacctaggcaatatggacataggaataggtaaagatttcataacaaagatgccaaaatcaatctcaacagaagcaaaaattgacaactggaatctagttaaactaaagagcaaaagaaactaatagagtaaacaggcaacctagagaatgggagaaaatttttgcaaaatatgcatcctacaaaggtctaatatccagcatctattaggaacttagacaaatttacaagaaaatcaaactacccattaaaaagtaggcaaggacaggaacacacacttttcaaatgaagacatacatgcagccaacaagcaaatgcaaaaaagctcaatatcactgatcattagagaaaggcaagtcaaaaccatctcataccggtcagaatggctattattaaaaagtcaaaaaataacagatgttggcaacgttgcagagaaaagagaacacttctacacggttggtgacagtataaattagttccaccattgtggaaaacagtatggtgattcctcaaagagctaaaaaagaatcagaagaatgtaatatttgttccattccctgataagtctggccaagtagaggagtgtgttggcgcacactaagtgcttatcgaatcaaccttacaaaaagacaaatttgacagtggtaataaacataaggcatggtggggcagagaattttgctcctgaagtttcagtcatgtggaataagaaagtattccaagatttttgtttgcaattgtggaaagaaagtagtctgagatttatgtctgcagttgtaaaataatattcaacatgtatgcctgaaggtcaaaaggcatctgtaagtctagtgaatgcatttacattttattttattttagtcttttgtcttggatgaatgcaaaaagagagcttttgaatgctgtagattaaaaggcaataggcttagcttttcttcttgctagagccaaaggagcagcttgcagctccctgtggtggacaaatagtgctcttgagaaatgctgcctgcagatttaagaacactaagacaaaggtaacctagcaataacaccatttccaacaaggtatccagttaattgtgcattcacattgtcaaagattgccagtctcatgttaaaatatacatgggcattcactacagaggagagaggtcataaattactcctattattgcacaggagtaaatgtgcaatggaggtttccttgttgctccttcacctgcagcttgttacaactttatgttcatagctaaactcggttgcagaggacatgaatgaatgacaacatcagtcaaatagcattccaacaagaaaaaattatctccttgaatgccaagaaggaaaggagggtggaagggagggagggatgaaagaagagagagagggaggaagaaaagaaggacgaagggagggagagaggaaaattaaagaaagataagggggagaaggaggggaaagaataaaaaagggagagagagagaaagaaaaaaagaaagaaagaaacaaagaaagcccagcccttcaaaccccacaatgatttctgagtgatttttaaagtttgcaaaatattgatatagtagaaaaaaatggatcaattccaaatttgttacaaatgtaaatgttagcaacatttagaaacaacaccacttttggcattaaattaaatggatttatcaaagatctacatcaaactggttcaaagagaagtataaaattttatcaaccattgacctcaacaaattaagcctacaacgaaaggcttgccattactaaaagcaccaggtcagatattagtgggacaacttttaaaatattaataaagaagcacctctgatgaaataatttttaaagaacaaagtaaaaatgaaattttactcagaaaatatacttagctttagcttagtaccagagtctgatataccacagaaataaaattcatgtgacaatattatttgtaaataatgatgtgaaaaacctagaaaaaatatgacttaactaggattttaatagaatgagtcatgtggccaaaaacattatcatcccagaagcataaaactttaatatgaggaaatagaatattaaaaaatattacatatttaggtcaatattttaaaacacttcaagtgtgtgcaggaagtaactacaattaaaatgttaattgcaatatgtctgcctattgaattatggcttactttagattctctctcccacatcaccacctttccaaaatgttctcaaacatattttttattgttatgctttaaatataaacaaaatattattttaaattgatgtttagaatttactaccattaagcatgcattaaagataaaacaaccttttagaaaatgaggcctaatcaaatattttattaaataaaccaactatttctccttaaaccaacatctagagaatcacttaatgatgtcatccttgaaactggcagccaatgaattgactcttcctgccattttcctgcaaactcgaattcactcaaatctgctatgtactgaattcttgtgtcccctgaaattcccgtgttgaagccctaacccccaaagttatggcatttggaggtggagcgctcataatgggatgagtgtccttacaaataaacaacaggagaccagagaccagagagcagagctctctctctcttccatgtgagggcacagtaagtcaggaagtgatccctcaccagagaagtccatctgccatgccttgaacttccagcctccagagctgtgagcaataaatgtctgttgtttaagccacccaatctatttagttagcagcctgaactaagacaagacttcaaaaggaaagagagatataattttgggaaagcacgaattataattataatttttaaagataatatatttaaatacatagacaattcaagacaaccaaattaacatgagaattaataaatctaaaagcatttctatgcattagcaatgattagttaaaagataagatggagaaaaatgaatctactcaaagtgaaattcttaaagaagcccacattgaaactttaataactttataagggaaagtatcaaatctaactagtataaacggagaggcatactatatatgtgatgtttatgactggatgctatagaaaaagagggaacaaggaaaaggggagaaaaggaaaattttctaccatgttgatatagagttttaatgaaaaacaaacacatttccaattacatttactttgtgacttggcacagtctattgtgaaaaatgaaaatatgtactatatattatgtaatatgtattacaaatgtaatatgcatgtaatataataaatgtaatgtgtttataatacattaccaaatgtaccatgtattacctttcaaaacaggtaatatgtatttttaaaaggaaaaaatctatcagataattaatatattatagtggacctaggattcacattcacactcacatgtactatgcatgtaatgtaataaatgtaatgtaatacattaccaaatgtagtatgtattacatttcaaaataggtaatatatatttttagaaggaaaaaatgtttaccaaataattaatatattatagtggacctagcattcacattcagagcacagaaaggaagaaataatcttgaagctgcccattgtatatataagagtaaaatataccagattaggacattacagatgaatttactttaaatggattgctaaagtaatgctgttttggggaattaaccccttgtaataaccagagctatagccatcatttccaaatgagttatggggtgaagttgaaagaatgcacttagaagaaaaaaacaagaggaggttcacagtcatggatggtgtccttagtggccagacagatataaattcacacagtcttcattatggccagacagtgccagtagcagacaaagagaggcagggtggtatggtggagagacactctggaatcagcaggctgggtataaattccaggcttcaagcctctgacattaaatctgtaaaatcaggataataattgtcacctcattgtgccatttgtgatgaactttaaagaaccaatatttgcaaggaaaagggggtccatgatgtcaaaaggctttgctctagttggaataaccttcctttgacacaaatatttctgataaatcagacagaattcactaaaagcagagccaatatttgcagagtgttcaaaaacagttctttgaacgtgcagaatatgataaagttttcttagatgaacccccagtagagtttttcagtaggcttgatggtgttttcctagtggacccagcaggagtatccttggcagctgggagttttcatgcagatggaacgtcaggggcttcacgatgaaaaatgctgcaatctcttattttgtagcattgtctgtggatgctaagttgcatcctttatctccgttaatggagtgtgtattatttttctacatttacagacatctttccatcagatgctcttgtccttgtgcaaactatatgaaagtcagaacatcaaaatgaaatatagaataagggaaaatggataaatgcaatgttaactgaccgctctgggcatgatggtgcaaggtgccatgttattgtattttctttcctgtcatttcgatgcattctcttgacttattctttccttcttttttggggaggaagggatatcaataaggccctatttaggagattaaaaaaatccagtccagtctagtcatggaaatcaaaactcttacccaagtaaagtttttcacttgccctatgccatggtttgaatatttgtcccctccaaaactcatgttgaaatgtaatctccagtgtagcagtattgagaggtggggcctgtgagaggtgactgggtaatgaaggctctgctatcatgaataatgcattaatgagttaatgcatttatggtttatcaagagagtgggagtagtggctttatgggaagaggaagagagacctgagccagcactattagcacccttgccatgtgatgccctgtgccacctcgggattctgcaaagtccccaccagcaataaagcactcaccaggctaggtgcagggtctcacagctgtaatcccagcattgtgggaggctgagatgggaagattgcttgaggccaggagttcaagaccagcctgaacaacatagtgagatgctgcctctccaaaaaaaaaaaaaaaaaaaaaaaaaaaaaaattagccaggcatggtggcatgtgccagtaatgccagttccttgggaggctgaggtgggaggatcccttgaagccaggagtttgaagctgcagtgagctatgatcatgccactgcactccaacctgggtgacggagtgagatcctgcctctaaaagtaaaaattacaaaaagaagcctttcaccagatgtagcgccttgacctgagacttctgagcctccaagtctgtaagaagtaaatttcttttgtttataacttaccaagtttcatgcattctgttagaagcaacagaaaacaaactaagaaaccctagttctagccagtctcggttcagaaatacaactggagtcaaaagccatggttaaatttttctaattttccacttactcttaagcaacattttgtctatttgctcaggtacctttcagtgcctgtttctttcaaggtaggagtgtggaaaacaacacacccaggtaaggcataagaaggaggtgttgtagaaaagtcgcacagttgaaatgtgatgtggctatgacagggtatggctgattcaaagccctgatttgttctttcctggggtattgttggggtctggagatatcattttcactagaaaagatttatgaagttttctttttccaggcactgtctccttcagctagatgtccttgggttctcttatggctttgatgtagtttcttttttattttattttatgttctggggtacatgtgcaggacgtgcaggtttgttacatagataaaagtgtcccatggtggtttgctgcacctattaacccgtcacctaggtatgaagcctggcatgcattagctatttttcctgatgctctccctcccttgccatccccctacaggccctggtgtgtgatgcttccctccctgtgtccatgtgctctcatcgttcagcttccacttagaagtgagaacatgcagtgtttggttttctgttcttgtgttagtttgctgatgataacgtcttctagctcatgcatgtccctccaaaggacatgatctcgttccttttggtagctgcatagcattccatggtttatatgtaccatattttctttatccaatctatcattgatgggcatttgggtggattccatgtctttgctattgtgaatagtaatggaatgatttatattcttttgggtatcaatagctgaattgaccaaatgatgcagtttcaatcatttgtcttcttggatgccagtttgcacagaaacccttcctgttctgtgctgggagcatataaccatggacaagaggtcactttcagagttttcagctgtgagtctcatatatttcatcctcaaggaggcatatgttaagctccctgatttgatctcataacaagggaaatgttaccaaaacactaggggtttagtttaggtcctgttgctcaccagagagaaagccaattactgagacaggtgttgccaaggaagaagacttttatgggtgcagcagccaaggggacaggggatcaatgtcaaatccatctctgcaaccaagtcaaactgaaggtttatatgttgcggaaggaatctacaggaattgggggaggtgggtaaggaaaaggagcttcagttccttgatactagctgcgaggcctgagagtcagtttcctgagaaaggaaatcagattagaccaatgtgagtttcaagctttaagactgggaggaaccatctctatgttgattaaaaataataacaataggctggccatggtggatcatgcctgtaatcccaacactttgggaggctgaggtgggtggaccacctgaggtcaggagtttgagaccagccttgccaacatggtgaaacctcgtctctactgaaaatgcaaaaattagctggacgtggtggtatgcacctgtaatcccagctactggcaggagaatcacttgaacccaaggcggcagaggtcgcagtgagctaagattgtgccactgtactcaagcctgggtgacagagtgacactctgtctcaaaataaataaatacataaaaataaaaaaattttataattaaaaccaaactaaaaatttaaaaaattaaaaaattttaaaaatgaaaaagtaaaaaaactagttttcaatcattaatttagaagccaatcctaaaatctgaaggttgaaaagctgaaacaaaaaggaatcagatgaggcgtaatccatgctgattcattcttctttcaaagcaagctctcaaaatcttgttttatcttgtatacacacacacacacactctttctctttctcttaagaaatatagaggagaaataaaagagaattttactgaacaaaatcaggtgataaacaggagtaagtggacaaataatcataaatatatcaagctaactgtaatcatcagttgtattaaagaaactctttaatgcaggagtgtaggactgtcaagaatggtgaatgatctgagatatcaccctccttgcaaacagaccatttagcttagcatgttttcataaatgctgatggaagacatgagattcctgattcagagacaaaagatactattacgcacagcaggaaacatgagcttcaacttcaagtgtgtgggagttctccctgcattctccctgtcattctctctgtgacttctccctgtcattctgtagggatgacttagagtgtctgagtaaatactgctcatgctgtaagttcgtgttacatctgagggacttcaagcttaagaaattcccatctttcgtgagagtgagaaactgcctaccgtttgcctctggtggagatgttatctttatgatactggacagttctccccaccagagattcttccaactatgttgttatgtttcaaacatctttgaaaaacattcagaatagaagttgttgatcctcctcaggaaataattgcatctcaagagagacagtaatcaccactaaagccactttgacttgatattgttttagacaacatacctgagacaaaagcaatttttaaaaatcatacaaaatcagaaagagataacacattagcaacattcacagttaataggaatgcaaaagtgataaaaaattaaatttcttccttaagcaatgacgtcatgcggtaaatctgcaggataaagaaatgaatacataaaaattaatagcaaattatatacacacatataatttagaaaataaaaagaaataaaatacgcaaatataaactaaggacgaaattatagtagtcctaggacttcaggagtaaacgtatcagagaaacacataagctttataaaaaatacagttgagagttcacttaggcacagatttttttttttcaaccaaatgaggatcgaaaacacagtattcatgagatgggcaatctgagtatactgagtttactcgttttactaaggtccaatttatgcaagttctgcaaggcatgctttgggacatgagtatgctcagattttggtataagcaggagtcctggagtctatctgtctcatatactgaggatgattgtaattccagtgttataaaggaggatacaatctacgtggattaaggaaaacaagcactatctttgtgcccaagttatcaatactagatatcaattatctccaaattaaactataagtgagtgcaattctactttaaaataccactttttttgaaggaaaagaaatcagatatggtgactcttttatagaaaatcaaactggggagaatagaatattctgaaacagactgataatgcatggaattttccctaccatctaatttatattagtgctttatttataccttagacaagcatgaagctcatagcggaaactgaggtctccaaatgcttgtgtataactcttccactacctcttactagattcaagacatacagcaagttccttagcatcattgtgtttatattttctcattttttcaattgtgacaataaatcactagtattgtcagtcttttgtataaatggaaaggaatttgtatacaagatctagttaaaatattgtcctgtatgtagtatgcatatcgcccgcaaaatgtagggggtacctaatttttagctatggtgtcattacttttggcataattggaaatggaataatgagttgggattaggatatgaagagttgaataaatacttgcaataaagtagtgcatccaggaacagatcccaaaatataaaacaagttagtatatgatgtaggcttccatcacatttgaaaatttttagtagtaagtgagtatcccttgaggggggaaaggtgattcctgtcatccatttatatacactaaaattcatttcctctggattaaatatttcaaggtaaaaaggagtacaatacagtgccagaaaaaagcttgaaatgattttgcttaaatgatctcagagtggtaaatatggttttagcactgaactcacgtattgttaaaatgttggtatattggattacattttaatagattgcaagtactatcagtaaaatcagagtacacatgaaaacattaagtattaaattctttaatatataagtataatgtgtattttaatatacaaatacataaataatattttaaaaggataatatacattattcacaaaaatactatttaaggccgggtgcgacagctcacgcctgtaatcccagcacttcagaaggccg[134 bp omitted]gacgcaggagaatggcgtgaacccgggaggtggagcttgcagtgagccgagattgcgacactgcactccagcctgggtgacagagtgagactccatctcaaaaaaaaaaaaaaaaaaaaaaaaaaaaaaaaaaaacacgatttaatttacaaataagctattactcatcacattggtagaaatgtcaattaaaatttaaacattcacttcatagattggtaaagaggacgtttcataacacacagcaaattgatgagtggatggagaaactctctcataaataactgataagaaaatagactattgtaacatcattggaggaattttgcaatacccatcatgatgaaaaatacacatacattttgatgcaggagttccagttttaggaacagttttaatcaggagtgtgtaacgaatcagaagcatcttgcttttctcagggcagttcctggaagctccacccaccaccttccactcacgtctcattggttaggaagagctccagatgggcatgctaccttctggggaatctgagcaggtaaagatttttatctggacacattgcctttctaagcaaaactgccattacatagtggtttattgttcttttcaattttattaggcagcctccaaaaccagaacaagttcagagggaatcctcatagtggtttcttatacagatacgtagaaagattaaagaccaagatagtagacatcgtacaaataagtgtgtgtgtatatgcatttgtgtaagtatgtggggtgtgtgtgtgtgtattgtttaaaagggcaaaaagattaaaaagaaagatagtggacattgtacaaataaatgtttgtacatgcatttgtgtatgtgtttgtgtgtgtgtgtatgtatatgtatattttttgaaggacaaaaaaaatcttggtaataatttgcctctcatcaataggagtggaagaagcatatttcattttatatattgaattgtaatgaaatttttaccatataattattactttgtaataatacactcaagactattacatatgatatatatattagtaatactaatcatacatattaatacatatataatatctacatattacttatatgaatatatagtacctattacatacgtgttaaaatattctgtatgtatataatatacacatgtgttatatataatatattttaggtaatgcatacatatatatatatgtatgtatgtattgtaaaccaaaaataaacttctaaggcctgccccaaccatctgagtggacctctcctctcagacaagggcattccggggttaacctgaaaatctagttcaggccatgactgaggagaagggagtcagacatgcctcattctacccctcggtattaacatcaacacagaccttaagtctgataagaaacgtttacaatctattgtatgtgaagctgtctacctggaggcttcatctgcatggcaaaaccttggtctccacaaccctttatcttaatgcagatattcctttctactgatagtaggttggtgcaaaagtaattgcagcttttgccatggaaagtaaaccgcaattacttttgcacaaacctaataataacgctttcaaccaattggcaatcagaaaaattttaaacctacctatgacctacaagtcccgcacctttctacttccagttgtccaacccttcccgatcaaaccaatgtaaatcttatatgtgtattgactgatgtattatgtctccctaaaatgtataaaagcaaactgtgccctgactaccttgggcacatatcatcaggacctcccgaggttgtgtcacaggtgcatccttaaccgtggcaaaattaactttctaaattgattgagacctgtcttagatattttgagttcacagtgtacattttaaatatatacataaatgtacatgcatagcttagtacacttaattgtacattattaaggtattatgaaagactcaaggagttaatatatgagaagacacttggtaaaatgaacacaaagtataccaacctaagtaattaatttactcactgaaacaatttatatttgtttcacttcaaaacctgtttcaaacaccaattaaataaagttcagtatgtctccaagtttaaactaaaaacaaggtcaacaaaatttcctcacccatcaactttatccagacaaagccattagaatgtgtctgagaggaaaagcattttaattggtgtataataaacattaaaagctctcccaagtggaaatggcttgatgaagtcaagccgtgcttattaatcagagtctggatttcaatgttgatgccgcctcacttccctgctttttcatcttcagttttcacaatattttctgatttattttgtggggggagtatctgactctctcttcaaatcaaaacagaaactagaaataaaaactgataggtttttactttggtagatgcagtagaaatgttcacagagtggttcagatatgtatacatggaaattagtcttcagtggtgaaatttaaggggtcaaagatcattttggaagcaatatttgcaacaaaatgctttcactctatatgaattctctaaaccattatttgaatgtgaacatcaataaggtcctgctcccatagagaatgcaacaggcagagagattacgcatctcttgtatcctcattttccatctgggaaagttcaaggcactaatgagctctaggaatacaaagataaataggatgttgttttggtgctaaggagcccatcataaccacaaatgtaggagtgaattaggttggtagaacgagtaatagtctcagatttaggttgcaacaatggcttcacgaaattttagccatgcaaacttgaatacatttatctccctgacacttacttttcttgcctttgaagtgagatgaatacttctatactgagctaacatatcttcgcaaagattaagcaagaaattgattgaagagcatctatactcatgtctgacacatggtgcagagactacaagcaaattttagttttccctaaaacacaagtgctgaaataaaaggtgtagaaagtactgcaggaggaagaaagataatgtacataatcttttgtggggaggaggcagaagaagtgatgagagattatttgaattatgtgaatcctaggaaaagaatcatagacaaaaagtggcaccggtggtggggcagaggacttggtgtag[133 bp omitted]gaaaccccgtctctactaaaaatacaaaaattagctgggtgtggtggtgcgcagtgtaatcccagctactcaggaggctgaggcaggagaattgcttgaacaattctcaagggaggtggaggttgcagtgagctgagatcgcaccactgcagtccagcctgggagacagagcaagactccgtctcagaaaaaaaaaaaaaagatgtagactaacaaggtattcttctgcaattcaatttttactttctaagtgaggagtagacagtggtatgccatgggagctggttaaggaaaacttaaagcatgggtttctgcttttgagtctttaaagaaagagaactcttggagacatgttgaatgttgagtgatgaaattgaatttggagaaaagtaagtcagtgataccaatttattcatttgttagaaattgatttgtctccctcaaaaagatatgttgaattcctcatctctagtacttgtgaatgtgacctcatttgaaaatagggtctttgcagatgtaattaagatgtaagttaagacaaggtcatagtgcagtagggtgggaacttaatcctgtatgactagtgtctttataagaagaggaggctgggcatggtggcttatccccacaatcccagtactttggaaggccagggcgggattgcttgagctcacaagtttcagaccagcctgggaaacatggtgagaccctgtctctacaaaaaatacaaaaattagccaggtgtggtggtgcacgcctgtagtcccagctactgaggaggctgagatgggaggatcacttgagcccaggaggcagaggttgcag[132 bp omitted]gaacaacacacatagggaggaaaagacacagacacacagtcatgatctaggcagaggttgcagtgatgtggccacagcccaaggattgacagaaaccagcagagctgggagagtcaagaaagtattctctgatagagctctcagagacagtacagacctgccaacaccttgaattctgacttgtggtggcttgaactgtgagaagataaattaatcttgactgaagccgccaagtttgtggaacattgtttctgtagctctagaaactaatacagatggaatggacagaaggaacgtcatcatgtgggaacagagaacaagggatggctttaataagtaatcagatgttacgatctggctgggcacggtgggtcacacctgtaatcccagctctctgggaggctgagacaggcagatggtttgaggccaggagtttgaggccagcctgggcaacagagtgaaaccccatctctacaaaaaataaaaaaataagccaggtgtggtggcttacacctgtagtcccagctactcaggaggctgagttgggaggattgcttaagcctggaaggttgaggctacggtgagctgggtgacagagaaagactgtcgcaaaaaaaaaaaaaaaagtgagaattagattcagagaaaaccaaaaagggcaaggctgctgaagtctcttcctacaaggactgggtgggtaatgctaactttaatcaattgatgaatactccaggaaaagaacttttggggaactaatgtgttcgttgttggtcatacatttgagctgtgtgctgggaaattaggaggagaaatctagacacggagagagagaaatcaaagaaccctgagatgaagcaggcaaaatgttgcctagcagaatgcaagctacaaaaccgagatagaaggcactttcatgagaacaggtggccaacacttccaactgcatgctcctttgctggagagagctacgtctgataagcagaacaggagaggtccattcaaagtcatcattctgataagaaccagagtcaagaaggaagtttagatttttctcactcatcatccacgttttgatgtcagttgaaacctaaattgattgccagtgcagaatgcttcaagattataccatttctaacaaagaagagctttagaaattgctgtgtcttttagagtccatcatttcaccatacaaggtcaaacacatctgaggataggtacttcctcttataataaaagttttagaccctcctcctgcattctaagaaggtttccctgaagtctgcacatgccttgacggacagagagaagatagatggccatttattacctgcaatttccccagtactaacttaggtgccccattaaaccatctatcagccctgctaggtacgaccatttccccagttttccacatgaggaagcaggtgatgggatttttcaaggtcatgcaagtagtggctcacccatgtggtctttgaaaccaagcctgagccctttctgttttcaccgtgctgcactcctggctgacatctagtgctttggtgcattttctagatgaccgtcaaagtaacattgttataggggtatatcagggcttttttttgacatcattatggtaaacctccctgtccctttggatatttttaagaggagcaaggaacattatgccccttcctgcttcatctagcaacttagcataatgagtacatttcctgctttttttttttttttcttttgacaactgcacaactccatcagacctctgcttgtgtttcggtgtttgacattgttctctcaggtatcctttgagtttgaagagtcccgaattattctacagaggagccatgatccttgctttctcatgagtgccagaaataatataaaccagacaccatgaataatacatgagcatcaatttcacatcagggttatttctggcaccgactgtctgtctgtcaatagcatattaacagcaggcactgtttttttttttttttatgatggtagaatggtaaaaataatgaactggcattcagccttggagattctctctggaatgtaatgttcctctgtctaatactttttaaaacatagacgtgaagaagttttgtggtttggcaaaagaatcctggctctacttttggtgttttgttgtctttattgaaatagaaagggtggatgttttgtacacagttctggaggtggcagtctggctgtgtcgcagactgagaataataagttcccttaaagaccatcacggcttcctcagcatcttctattcttggataataaccacggctcctagaaactgccaccactaatgacctattctttatgatagcttacttcgcaccacagtgagaagtatttttctccattagaagtttaagtgttcagcagtaaaattggcaagaaaaccactggcttgcatacaaagcctacaggttgctattctaatgactttctgttcaaatacacattccaattaaaaggagaatgtggagacccagcacaggcaaagatgaacagccaaggagctgaaagtccgccaatgttccatacgttacataacacagccttcctcacatgttagaatctactccctctgtttctgatgattcttctgactcttcataaaactctcatcaccctgagtttgttatattgctgaggcattttatgcgtttgaagagctttaattttgaggtcttctgtgtttgaggtttaaaggaaatattccttcctgccaggtcaaagcaattaaatcatagtttgttgcactgaaaactggatttcagagatgtggtctgactctcgcatgagtctctttgattcagaaacatttagtatctgttcactctctggcactaagccgagcaccaagggaacacgtatgaatgagtctgagttgttttcctgcaagagattttagattacgactgagtgaagagcgtgtaagggctctcaatagaaaaatcaaggataaggctaaatgaaaaatgaatattgggtccaaaggagtagaaagagatcagatattttgtcacagaggttgagttgggaagactttgaagaaagagatgccatttgaggtgggactttaagaattttgaagtttggaccagaaaaaaagggaactttctgataataatataatttttaaaagctaaagcaaaggattgggttctttaggagcctggaagcaaattagagtgatggaatattccagcatgaacctcaagcaaagcaagaaaactcaagaccccaaaattcgtcaggcagcagaacctgttggcttttgtgtatataacatggcacaatgtttctactttctcctctgggcagtaaggggctggcctgtggaggggtgtgctggcagcaggcaggatgattaaaatgcagagatgatattttttagggggtggtactcttttttcttttttcagacggagtctcaccctgtcatccaggctgtaacactgcaacctccgcctccctggttcaaacgattctcctgcttcagcctcccaagtagctgggattacaggtgcctgccaccacacccagctaatttttgtacttttagtagagacggggtttcaccatggtggccaagctaatctcgaactcctgacccctcagcctcccaaagtgctgggattacaggcattagccactgtgcccggccggggttggcactctttaagtattgatgtgatcttgatcaattgcaatggtcaagaaaaagaggggatctaaatgaggaaagctatgaagcaagaatccctggaatttggggtccaaataaatatgagtatagaatgaggacagagtctctgctgaggttttagcttggattccaaactgcgttaagaaaagtattacaaatagaaagccctgaaggaacacacagtttttgggataaggaggaagatgcctcttgctttaggaatgttaatcacacccaatcccattatcgggtatatagccaaaggaatataaatccttctgccataaagacaatgcatgcatatgttcactgcagcaagattcacaatagcaaagatgtggaatcaacctagatgcccatcaacagtggactggataaagaaaatctggtacatatacacatatatactacacagctataaacaagaatgagatcatgtcctttgcagcaacatgaatggagctgagggccattaccctaagcaaagtaacacaggaacagaaaaccaaacactatatgctctcacttataagtgggagctaaacattgagtacacacgaattcaatgaagggaacaacagacaccggggcctactggagggtggaagaagggaggaaggagagaatggaaaaactacctatcagatgctatgcttattacctgggtgacaaaattatctgtaccctgtaccccggtgatgttcaatttatctacgtaacaaacctgcacatggaccactgaaccaaaaatacaagtaaaaaaaaaaatgttaatttgagatgcttttaatcctttgagtagagttcaaattttggtctggagctcaagagagtaatggcagatggaaatagagaaagtgaatgctgagctagctagagggttagtttcccagggctgcttgaataaattgcaataaactgaggagctcaaaatcaaggtgtctttagggtcatgctcccatggaaggccctaggggaggctgcttcttgcatcttccattttctggtggctgcaggtgttccttggcatgtggctgcatcagtccaatctctgcctccatgttcccatgttcttctttctcttgtctctgtgtcatgaaactagtcattggatttagggcccacgagtttacctcaagatcttaattgcatcagcaaagaccctatttccaaataaagtcacattctgaggttcccagagcacatgaagtttaggagtgcactcttcaacccaggatagctacagaggggcaaagctgaagtaatgaaggctgataatgttgaccagagacaaaaatagtgtgaatgcaggattgagtcacgaaagatgccctggagaatataattgatgggaagaccaatgggagtaaagttcaaagaagacccaagtccctttcaagtgctaagaggaaaccaggagagacttcaaatgcatggcaagaggatggctttccatcgatgagggggaattttcagaggttattgcctcagacaggggaactaatgggtaaactcttcagagtcctacagggctggaaagtaacaggacagaagctctgtgggtcagtgcattttcagtgcttttagagttgtcagggcaacctcatcaatatcagtcgaatcagcatttataaattcgtcaatgtgtctctttaaaaacaagacagacagacggacaaatacagtcaaggggtgaatgcttgtatttatttatttttattattattttttagacagggtcttgctctgttgcctaggctggagtacaatgtgtgaaatggtataatcatagctgactgcagccatgacctcctgggctcaagcaatcctcccatctcagcctccaaagtagctgggactataaggacacaccatcacgcctaatttttaaaaattttttgcatagacagggtcttgctatgtaattcaggctggtcttgaactcctggattcaagcaatcctcctgcctcagccttccaaactgctgggattacaggtgtgagcagccacacccagccttgaatgcattctttaaataaagatgagttggttggtgttaagtgtgcaattgaagatgttttataaccagcagaaactattgcagaagagttaacttctgttcacttataaaaagtcatttggcagcacattaaacataagttatgagaatctttataaaatagctgaagtcagcctccctcaccacttgctttagaatttattggaaaacatatttgcagaaaagaaaagcaaaacaacagggataatatcatgcttgacttcacttgtcaacatgggaagactgaaaagaagaaccagtcgactttcttctttaattgagaaataggtttatagacctataaggacatgcatacaacttagatcactcaagttcttgacaaggccaattttagcaattgaaattatgttaaatgtagcttttagtgtcttgtttctacattggatccatgtgtttttgtaataggcagcaatagcaaccgctactacgtttcttaagcggtgactacagtttcacaaaataacgttcagaatccagattccaaaggtattttataaaggcattggccctgttgcctatctttgttttcaaacataattaattttacttcattatatgaagctattgttggactttgtcatattgtttcatttgggactaaggagattgagtattgatgaaacaggaaacacttacacatgcttaaacactttaaattgatatatttaatacaattttaatttacctctttgttggccaggcacagtggctcactcctttaatcccagcactttgagaggctgaggcgggcggatcacttgaggtcaggagtttgagaccagcctggccaacatggagaaactctatttctatcataaatacaaaaattatctgggcctgatggcacacgcctgtaatcccagctacttggggggttgaggtacaagaatcagttgaacccaggaggcagaggttgcagtgagccaaggtcccaccactgcactccagcctggacgacagagactcgtctcaaaaaaataaaaataaaaataaataaataaaattacctatttgttacaagaaatctgtgcagaaagtaagggtagtataagaagtctaagacaaatagctgtatcaaaacagctgaatatgaaccaaattgcaagaagtaccgtctttcaccatgggaagggctgtgaactgtgttcagtaagcattaacacactcagtttatattataatccactgagaaggtattattaggccagtgttaaagacagtgccactttaacttagagtgtttaaataacttttccaggacaatatagctagcaaagggacacactaggttttgaaactttccctttctatctctgaactccatgtgtttaaccactcaactatgtcacatccctggacatccagaatgtctaattaattattaaacaaactgcattaggagactgaaggctaaagagagattctgtagaagcagaagcctgggccatgctcagaagacagccacaatgaaactacattagaatataaatatctcttttgccggatttcatttgtattgggaaggtctcataacccagcataattttccatgtgcttacccatgtcttaagtgatttagagattcagaatgattttcctgacactggcaatttttgctgaaattatatacatcttcaaaaattatttcagaaaatagggaaggaacactcagaggcttattttatgtcaacgtaattttaatagcaactcctgacaaagatatcacaaagaagagtaaattacagaatgataatttcgtaccaaagtggatacaaaaatattaaagataaaatctccacatacagtaagaataatgcaaatttctttctttttcttcttcttcttcttcttttttttttttttttttagaaagaatctcgttccgtcgcccaggcggtagtgcagtggtatgatcataactcacctcagcctccaactcctgggctcaagaagtcctccagcctcagcctcctgagtggctgggactacaggtgtgtgccaccatccccaactaatttttaaattttttgtagagtcagggtcttactaggttgcccaagctggtcttgaactcctgggctcaagtgatcctcctgcctcagcctcccaaagtgttagaattataggtgtgagcccataatccagcctggaatttctttaatttgatcagtgccacctaatttaaaaacttacactaacattgtactttatattgaaatatggaacactgcctttttgagattgggagctcagcatggacatgcactctcacctcatttcttcaagattgtgctggaagtctcagccactgcaatgacccaagaaagacaagcacatttcataaagattaaaaaacaatgagtgaaattgtctatatccaaagacaatatgcttttcaaatgcagaaaatcctaatgaacgtgcaaaatcaataacagaaccattaaatgaacttagcaaggttgcaatttacagagtcaatataaataaatcgttttttctacctactagcagctagcaattgtaagtaaaactttaaaaaaatactttcaccttagcataaaaacaaaaaatgttcagcatattaaaaaaagttatccaagatctcttcactgaaatccacgtagcatggctctaagaaaataagaaggctgagataaatcggaatatatgccatgtgtatggatggattagaagacctaactttgttaaatacaaaaccttctcaaattgattgatatatttaatgcaattttcctcattatactgccaggcttttgaagcagaaatggtcaagtataatctaagtattatctggaaatgtaaggaccaagaagaggcacgtgatgttgaaaaagaattgcatatgtaagaggctgtgtaattccagaatttactgtcaacatcaggaattaagagggcctgttattatcctatacgaaggcaaattaccactggataaaaataaagaggacataaattgatcctcatttatatagtatactgatttttggcaagaatgcccaagaaatttaatgggaaaagaatgtctgataaatagtgataaaataactgaataaccatatagaacatagagtttcaaaacttacaactactttttaagaaacctataaaaattagtaatccctgagtattgtattttagagaaattaatgtcaaattacatatgtgttcattattcatatacatacatatatatggcatatgcatataattatatatgcaaatgtataaccatatatctcaacatttttcttggaaaattcctttgagttagacttataaggtctacagaaatgacatgcaagccttcatagccagttatttataagaaattataagtaaaatatgagttatggtttcacatttgtatacaatatacacaatggctaaaggaacatagatgctgttagatttagtagatcatttcagtgacaagaggccaaacccaatttgtttttgcacttttcaggtatatttcttcctataactaataaattgttttagatcatccttgaaatgtattgcttttgtgcataagacatcctactattccattactctgattttgtccccattttgttcatttcaaaataagaatgatgctttttaaaaatagcaagttttgtgagatttatctttttatctgcctgatgcttctctgttcctctcatttttcattcttgaccctacccaggcattcatagactaaggctcattttcaaagtaaacaaactcaatgtttttcattgtagtccaaaagggaatgacgtttaacatgaaatgcaaagatgactttgaagagctatcttgtaatcccttcctctcaacattatgattattgatttataactcagcgatgaaatcccatgagacccaatgaatgaaaataatatttgaagcatagaacagtaccagctttgaaagcctatatcatacatattagaatgatctactcttgtaagtcagcatactaacgtcatcatacaaaaatcaaaagttttgttgcttttaatttttttttttttaaagacaggttcttactatgctgtgtaggctggtcttgaactcctgggctcaagtagtcctccagcctcagcctccctcctgtatagctaggactacacatgcataccaccaagcctggcaaaaaaaaagaaaaaatttctaagtttcaaaagtactttgagtttttaatggtttcatgtcatacaagttttcatagctcaagggactgctttgaattacagcatctgtctcagtgtggagttactccttcaatctaataaaaactaagagaattttcatctctatctaaggctgctgtgtatcttataaatagcactgagttgtgataacttttaagtagcctataaaatgatttttaaagaataatttttgaaaagcagagcaaagaataaatcaatggttttacagagagaaatggtaataggaacgaatacaaaattatccatgccatttttaaattaagctttttcttcaagatctggcaggggaaaaataaaggctagaaagtaatgagctatatatgaacttgacaagaacaattttaagttgtactcatttgtcacctgccattaaagtttagctgatattttgctcttaatcattcatctaaaacctaccccaatctggaggtttttgtcccagactccatttttgggatgtctgttttaaacttcttttcaggataaaagttcataaaagcaagcatggcaatccactcatagttaaatggacaattctatttaaaacataatcaaaatggaagttaaaaattgttaaaaccatttaaaatttaattattgcaacatgtttgcttttgatttctaatcactgtcttgtaaattacgatcagcgattgggccagataatctgcattatattgtaattgaactcccaggaccttatgtatttatttagcctaaatgtagctcattcagtgagacttgatttacagtcagggtatacattattacttagagagtacagaccatttttaacaacctaaaaggcatacctcatcagacagatataaagaaagaatgataatggctcatttaaaatattaagatatcaatagggccaggcacagtggctcacacctgtaatcccagcactttgggaggccaaggcaggtggaattacctgaggtgaggagttcgagaccagcctggcaaacatggtgaaaccctgtctctactaaaaatacaaaaattaactggacgtggtggtgggggcctataatctcagctactcgggaggctgaggcaggagaatcgcttgaacccgggaggcagaggttgcagtgagctgagatcgtgccattgcactccagcctgggcaacaagagtgaaactctgtctcaaaaaaaaaaaaaatcaattaactataatagtcatattttaaataaaatatggtcacatttttaaaacgtctactcagatacagaatgagaaatttctaataaaaaattttaatttctaataaaattaatttctagaattaatttggaatcaaattttaatgatttattaaacaatcttgatgtcctgatgcttgaatgataggataagaagtgactcgattccagagggagaagttatatgacacaaagaaaagataaaacagaaacttgttattgtgtttttgtttttaacatgtggagatttggaaatgaattaataactagaaatgagtacataatgtgcatgaatttaaggtggagccaagttctctctgaacccatcatgggtgttcttagttgtaatacctaattaattatatctatgtctgtaactattggtgtttaaaagggtcacttgtgtatgtcatagaattatgagtttaatcactgatctatcatcactttgtacaaaacaaattaagcattacctaattaaaatatttaggcaaaaaaaagagaattcatacaactactttaacatatgtataatggattgagtgtttatgtgtacgtgtgtgtgtgtgtgtgtgtgtgtgtttgaggttctatctatatttctgggaatgtatttgctatgtctttggtaccaatgagactaatgatttagtgaattaattcaagcaatctggcttaatatggatgcaaataaaaactatgtcacattcatcactgattaatatctgtctctaagctatagatgccaaatatttgaacatgataaaggagtattcctagaaaaggtaaaaagatcatctaagaaacaattcatttttaaattatagtcagtgatttggataaaagaaatacatagaaatatcaagtcatgattataattgatataatcaattatataattatgattgtatatttaatatctatatatcaatatcaatatacagtcatgattataattgtttaaacctataatgaaaaacaaaaaacattgctctcattcttgagagtaatgttattatgtatataggaacatgttcgttaggatatatatatatatatatatatatatatatatatatatatatataaaacttagaagaaaaagaaaaatgcagaactccttgttagtagaaacagattgaaaaagtcaacttggataggtagcatgacccatttctgttcttccagtcaaatacttgagtttatgttgaatagtggtggtttctggcctcatagtccttcccaatactttcacctcctccattgctcaccatcaggctgcaaaaattcagaactagtgttacatataaagttaccccatgaacaagcagttttactcaaagaagaatgaaagtatccactcaaaagatttgcacacatgttcaaagcagcattgttcatgagacccaaaaagtagaaacaactcaagtgtctattgatggatgaatgcccacacaaaagggggtctatccacgcaagggaatattattcagctatacatgggcacaaagcaccaatacatgctacaacatggatgaaacttgaaaacactatatgaggcaaaagaagaaaatcacaaaaggccatatattacatgattctgtttatacgaaatgtccaggaaaggccaatccacagagagtaagtagattactgattaccagagactggggaaaagtaaatgggaattggctgctaacggttattgggtttctctttgggataacgaaaagtgttctggaactagagagcggtgctgattgcacaacattgtgaatatagtaaaagctactaaattgtgcaatttgaaatagtgacatttatggtttgtgagttaaatttctctttaaaaatgcatgatgacagaagaatagattaacgtttattaagtcgaagtgttctaaatccatgcaagttcagggaagtgggaaaaattataaatttataatttttatgttgacataaaattcttatgttgacttcagcaacataagaaggtacattttaatttcaataatatctagttaaataatggtaaaacccctgcaaaacaaactagtaaatggctgaaaaaatatgaataagaactttgagaaaaaaatgaaaattattgaaagacggtatggcagcagaagaagaaacaaagcacaggcagggaaaaaacaataatgctacaataaaacaaataatagaaaaaagaaatagtaatacaatacgtatgtcatatgtttagttcaaatatgtcagtaattatgctagatgttagtcatctaatatttcaatatttgaaatattttcagactagattacaaagtaaaatattattatatgttacttactagagaggcatattaagcacagaggtaacagaatattttaagtagaagaatagaaaaatatgtttaatatcatgtaaacattaaccaagccacattggaataattatcctaatgttattctatgtagactagaaagcagaattgccaaaaaataaggtttcataaagaaatccattacagacataatgattttaatgcatatgtatgcaaatgacaaagctccaaaaatatgattgacagaaacaaaggaaaagatagagatatccaaaatcagagtgagtgatactgaatgcagaaactgatataaatttagcaaaaatccccagtaagataaagacaactttaacaatacaattaataaaattggttagtatgcactcattttaacaatacttgaaacgtctgcccgatttgataatatgctggaacataatttaaggttaggcaattttcaaagtgctgaattcacagtgaatggtccctggtctcagtaaaattaatttagaaatcaactggacaaaacaaaatacccaattatttgaaaattaagcaatacatttccagataacttactggtcaaagaagaaattacattgcaatttagaaaaaaaacttagaactatataataataaaaaataaagtgtgtccaagcaggtgttatgaaattccaattgaatttagtgaaaatgtatggatgttaatacatacatgagaaaaaagaaaagttgaaaaacaagtatgaattatctaaatcatgcatgtggaagaaattccagcaaatagaatgcaaacaaagcaaaagggagaatatatattgtacttcacaggagacattaaacaaataataagcagtacaaataatagtgtgaatcaacagtgcaataagttatttctttgcaaagagtaatataacataaacttcccataagactatcccagaaatagagacggccccattaataaactgagaaaccaaaggtaacatcattttacactaaactatatcaaaagaacccatgtacaaatacatgcttatttaataaaaatctagatgacatggacaaattcttttataatgtaacaaaaaataacaaagagtagaacctcaaggctgggtgcagtggctcacgcctgtaatcccagaactttgggacgccgaggcaggtggatcacccggggtcaggagttcgagaccagcctggccaacatggtgaaaccctgtctctactaaaaatacaaaaaattagccgggcgtggtggtgcatgcctgtaatcccagctactcgggagactgagggaggagaattgcttgaatctgggaggcaaaggttgcagtgagctgagatcgtgccattgcactccagcctgggcaacaagagagaaactgtctcaaacaaacaaacacagcaacaacaacaaaaaacaaagagtagaaactcaataacccctattaacttttttaaattattcactattttagatctttcacaaaaaaatctccaaacacaatggacacaatactgaattcatccaaaaattttctgaagaaacagcataaacaaactcttgcagagaatgaaaaaagaaagaaaaccttcccaatcattttatgagaacagcattaacctaataacaaatctggaaattgaattaaatacgatatctaccatatccagaaaggcaaatgtagataaaatattagcaaactaaatctatggtacataagataaataatgcatcttgtttaactgaagtttattgcagaaatacagggttgatttaacatttgaaaatcctcaatataattccctgcacaatggaataaacaactatatgatcatcttagtagtttagataaagcacttgataagacccattactgatttctaataaaactcttcacaatgctatgaatgagaacacccctttcagcagacaaactatatttccaataccagtaagactaaaattattcttaataatttattagtgaaagctgtttcatgaatatctgaaatgagacaaggatactggctattaaattttattctttccatttatcctgccctgaagattcttttggggaggctttaaaaagttttattttgtttttaattaacaaataatagttggacatattaatggggtacagtgtcatgttttcacacatatagacattgtgtaatgatcaaatcagggtaattagcacatccatcacctccaatacttgtcattccaaatttccttttctagatttttttttttttgagacacagtctcactttgtcacccagactggagtacagtggtgcgatgtcagctcactacaacctccacttcccaggttcaagcgattctcctgcctcagcctcctgagtagctgggactataggcccgtgccaccacacccagctaatttttgtattttttagtagagacagggtttttcaccatgttggccaggctggtctcgaactcctgaccccaggtgatccacctgcctcggcctcccaaagttctgggattacaggcgtgagccactgcgcccagccttgaggttctactctttaattgttattttttgttacattataaaagaatttgcccatgtcatctagatttttattaaataagcatgtatttgtacatgggttcttttaatatagcttagtgtaaaacaatgttacctttggtttctcagtttattaatggggccatctctatttctgggatagtcttatgggaagtttatgttatattactctttgcaaagaaataactattgcactgttggccaggctggtctcgaactcctaacctcaagtgatccacccatttcagcctccccaaatgctaggattacaagcatgagccacccacccggccctattctagatatactgaagtacagtatgcattactgtcgactatagtcaccctactgtgcaggagaacagcaggacttatttttcctgtctaattgtaacttcgtacccagtgaccaatctctctccttcccatctctcttgcctagtctctggtaactactgttctattctctgcttctatgaattcaacttttttagtttccccatataagtgaggccatgcagcattcgcccttctgtgcttggtttatttcacttaacaaagtatcttgtaggttcatccatgttgctgccaaggaccagaatccatttttttgcggctgaatagtattccatgtgtacatacgcaacattttctttatccattcactcactgatggacacataggttgattccatatctttgctgttgtgaatagtgctgtaataaacatgagagtgcaggtagtcctttgacataattgtttcttattattttgataaatggccagtagtaggattgctgaatcaaatggtagttctattcttagtttcttgaggaactgccgtattgttgtccatagtggctgtactaactgacattcctatgaatagtgtgtgagagtttttctttcttatagaatctttctttgataatttgatggttttaaagcagaggtgagcttttcgggctgaatatggtctgggtcatatatgcatatttcttttttcctttctctctctctttttgtatataatttatccaaaaggcaaaaaccatcattagctcaaggagcaaacaaaaatggaccatgggcttgatttgatgcatgtgctgtaattattttgacaactgtttaaaaggtgtgtgtttcatgtaggtcatcacatttgattatttagtgtatttaatgcatgtaggatctgcaaagatagcctgtgtttcccttctgatattgctaattgttggcgtgtatatatttatcatgatcaatgaaaccatagttatataaaattttttcagaataaatttggatttcaaatattttctctgtttctgtccatttaatagatttcatcttattttcatagtttgctttattatgcaagcacattggactgatttttggagactaatttttttgtactatatcagtgggtttaagccaaaattgggcaaactataggcctcaggccagctccctgcctgcttctgcgaaaaaaaaaaatgttttattagaaaaaatccacaccctgagacagtattgacatgcaatttcaatgactgcttatgtgccttcacgacacatgatccagctgaatagttgtaatacagaacttctgatctgcagatacacacacaagtcatatatatgtgtatatgtatatatacgtgtgtatatatatatggcatcagaatgaatatataatagaaatatttctgaattaataaaaagaatacttaccttattcagaactagtatatttatatatgtttcaaaatgaaatctattattcatagaagtcatcattgcccacatagaaaattcaaaagaatctatagatataccattttaaaaaatttagaaaagtttccaggcacaaagcaatataaaaatttttatatggcagaaaagcaagtcaatataaattcaatagtgaaaaaatttgttaaaatatcaaacatatcatatatttgaaaataattttaatgagatgtgctagtcatttgcactctacactgcagaatattattttgaggaattaaaaatcaaaatcagaaaaatgtaccatgttcgcgaataaggatgtcatttcttatcaaatttatagatttagcatgatcactataaaaatctcaatagtttgttactaatatatacaatctaatatgtacccacaaagtgatagcaaaacttttatggaaatataaaggaaaatgcatagctatgatatcttgaaactgaagaacaatactcaaagatatgcagtaccagacataactctgtaatatggaatacggtctttacaataaatggtgctagttcaattggacgtctgtatgaggaaatacgcatctttactgacagttaatatcacttacacaaattctttctagatgtattgtacacctaaatgcaaaatatgaaataataatgattttaggaaaaaaacagaaaatatcttcatgacactaattaagcaaaaatatttatctaggataaaatctttctatctatagaaggaaacattgatcaattggaataaaacaaaattaaactcttccatctaacacaagataccatgaaggaattaaaaatagaatccactgaatgaaaaatataagtacaataaatatatccaacaaaggattcatatctgtctatcatatttatctatcatctatttatcatgtttatcatctctatcatctatctatataatctatcagttatatctacctatcatctatctatctaattgatctattcatctattcaactatcatttatctatatccatctcttctatttgtctgtctgcctttctgtctattcatccatccatctattgatccatcaccctctattaaacacttcatgaaaaaacagacattttaattttactgagaacatttaaatgaacaacaaaactgtaatcaggttctcaacgttactcattattaagaaaatggaattaaaaacaaaatataataccactgtactcttaccaaagactaaaaatagaatgtcaggaaatatctagtgttaatgagaatgtagatccacttttttacatagctggaggaagtgttatatggcgcaggcactgtgtaaaacttttgttatgccttatgatccagaaattccacccttaagtatgtactcactagaaatgcatacatacatttaccagaacacatgcataagaatctgcttagcagcagttcttcaaaatagccatatatcagaaagaaaccagacacgggaaacaacagaaactcccatcaatatcagaatggaaaaaagttgtaaattcatatatattagaagattttacattacacccaactgcatacaaaatgaaggagtctcgtgcacataatgaaagaatccacttacaaaaaattatattctgtatggtttcaattctacaagatttagaaacaggcaaaatgatactctagtgttaaaactatacctagtcttaaaactatactccattgttgaaactatagtgtctacgctagggggtgaggctggccaaaaaataaataaataaataaaataaataaatggccagacacagtgaatgacacctgtaaacccagcaatttgggaggctgaggcaggaggatctcttgagctcaggaatttgagaccagcttgggcaatgtggcaaaaccacgtttctagaaaaaatacaaaaattagccgggcataatgactctcgccttgtggtcccagctacttgggggactgaggtgggaagaacacttgagcccaggaggtggaggctgcagtgagccatgatttcgccactgcactccctcctcggtgacaaaatgagacactgtctcacaaacaaaccaaaaaaaaaaaaaaaaaaaaaaaaaaaaagacacccagaagaattctgcatgcagaattatttacaagatttcctgaaacccactttaaagaacatttaaaaagaaatgcagtgatgtatttataagggtaattcatatgagagaaccatgccccttgcttcagggtagttaagagtaatgataccaaccctaacttttaactcttgacctaccataagaaggcaaatttgctgatgatatgatgaaatgactgcttaaactaaagggcatgatttcaaagctgaaaaatacatggaggaagagtgccttgtttctgtgagtacaattctgcaatgaagtctgcacaaaagatatgaatgttacttgatgttttcttcattctgaaacacatcctttaggaattctgtatcactatgtcttcaaattcccatggaacagcatctcatcattcatgaatacttaatgatgatgcaccacaatttgcagctacttttattctgacacatccttccttcccaagagcataggagatgcagatatcagagttgttgtatagggcagggcagtgacattgtggttcaagggagagaactgggatcatcatgggtcctgaggagcagagtcccctatgcatgatggaccaactgcacctctgtgtccattggggacctgagagagcctggaaaaagacgcagatgcacagtgtaccctggcttcactctgacgttatcagctgctcaccttgagtgctcccgatggactcctgcggaggaggtaattttggaagttgcattaactggatgaggccaccagatgaccatttggggcaccgtcggtcgaagtcatttcccataaaataccttaatggcctgaaaaagttaatgcgtctctcaaattgcctctgttaccacgacagaaccatgcattgaaagaattggttcccttgtatcttccacacaagcaacagaaatatcatcatcacctgctatttattaaaggccttgggccagcagatgtgcagtgcccaaagctaattaaatgggctgaggtctggttcagggactatgacatgggaattttaaagccatgcatagaaagaagctgctcaacctcctctattggaaaatgaaaatatagatctggcctctgcaaccagcttctttctcaagcttgttttctcattcccctagtggaaacgaggctttcatctattgctatcctgaagacatggtagaagtttaataaatagtagcaactattcagcaagtatttttgaatacttactgatatggtttggctctgtgtccccacgcaaatctcaagttgacttgtaattcccaaagttgagggagggacatggtgggaggtgattggatcatgggggaggattttcccccacgccattctcatgataatcattgagctctcacgagacctgatggtttattttaaagtgtatggcacatccctcttcgttatctccttctctcctgctccgccatggtaagacatgtctacttcccctttgccttccaccgtcattgtaagtttcctgaggcttcccagtcgtgcctcctgtacgcctgtggaactgtgagtcaattaaatctcttttcttcataaactacccagtctcaggtagttctttatagcactgagaaaatggactgatacgctgactgtcacagactgttgtctaatcattttagaagaaataactgatgtagcatccatcatagtacctcagatttgggggtgattttctcccctccatgggacatttggcaattccagagacatctttggttgtcagaatggagggatctactgggtaaaagcaagggatgctgccaaacctcctagagtacaaaagaatgttcagtgcagaatcttaatgcagccactgttgaaaatctctagagtttacaactcttagttttttttcaggctgttgaaagaaaacagggagggatagaagtagagtctcgaagatgctggaaagtgctctgaaactcagtctttgaatcagagctaaccaaatacagcattccacctacagcattatttgtataagaaacctggcaatcaagtggaccaagggaaatagttgtgatttttcataatcccaagagtttgtgcaaaggacaggcaaactgagaatttcaactatttccatgaaaccatccttacacttgtgcatggaaggtggaacagtagaaaatgtttgtcatgattgtgtgtgtgtgaaaaatgcaactgattaattttaacataactgggaaaatcgatgcagtcatatgcaaacttttagtgaatgcttgctttgaacttttctaaatctctaataaaatttgaagcagctacgcaatgcatcaaaacattccttgctctgtatatgctttggacttcatcttaacaagtctgattttatatatctctatatacaaatatgtaatatatatatgagcagtagatagcaagtatatagatatatttgcaatatgttataccagtagatagcaaatatacaaatatatttgctattagatagcaaatatatacatatatttgctattagatagcaaatatacaaatatatttgctattagatagcaaatatacaaatatatttgctattagatagcaaatatacaaatatatttgctattagatagcaaatatacaaatatgtttgctattagatagcaaatatacaaatatgtttgctattagatagcaaatatacaaatatgtttgctattagatagcaaatatacaaatatatttgctattagatagcaaatatatacatatatatagcaagatagacatacaaccatacaaatatatatatttgctatatatagcacacttataaatacatatatttgctacctactggttttatatatatatatatatatatacaccaatatatactgttattatatatagatagatagatttgctatctactggtattgtatatatattatatataatatttggcaaaaataatgtttatgtagtgttctaaacaagccctcattaaacagtcacccaaacgtgtatttctaggctacacacttccatattctaaggcttctaacttttgattatttcctactcaatgattaaaagactttatgaccaaaatgtagaaattatcaaaaggtcagcagaacaatgctaaatagtgataaagaaggtctctctgttagcataatgacctccaattccttccatgctttccatttatctgttgatggacacttaggttgcttccaaattttggctactgtgaacagtgctgacaagttagaaatgcaaccacatttgtctaaattgtcttcataaaaatataaattcatactttataattattgtagactattaataatattattatttaaaaatctactgcatacattgtaagttaatttcagcaaatttatgataagtgtttgtgaggacttattttatgtggcaacttgactatttggtaaaacaccagtctacatgctcttgtgaaggtactttgtagatgaggttaagatttaaatgagtagacattgagtaaagcaggttgctctgcagaatgcgtgtaggcctcatctaatcagttgatggtcttgatagaaaagactgatcccctctgcacctccaagaacagggaattctgcctccaggacggtcttcaaagtgaagctgcaacatcaactcttccctggatctcaatcctgcaagtctaccctgcacaatttgaacttgccagccctccacaatcaagagagccaattacttaaataaatcttccttttctttttttttctctttctctttctttctttctttctttctttttctttctttctttctctctttctttgtctctctctctctctctctctctctctctctttctccactccctattgactctatttatctggacaactgtgactaatacagtgcttaaaagttaaaccattagtatgcaccttattatatctatgaaagggattgcagcaaaaattttctagattgacaatgctattttccataactgacactgaaaataacaaatgcttccaatatgtcaagacctgtatccctaatgacaatgtgatataatgatgtcacagattttgcactttttaattgcattttattctccgcatatgtccttgagtacagattattaaatataactaagcaattttcttctttaaataacaaaagtactacttaaaagtaaagagaatttcaacttactgtgtttattcttcccatagggtgaagctggccccaggcatcctataacgtgcattaaacaaaaaacttctttatcagtgggaggttactaaatttcacattctctcaaagcttcaaaagaaaggaaaaagaaggaggaaggatgcccagattagacatgcaaactcttgaaaaaaagtctatttaataagagttgaaaaagtcagtcttgcattcaaagaggtcacacacttatcaaacctaccgtaagtttaaatgacagctggtgtcaatcatgaattctattagaaacatttattttgaagcattacatcaaaaagcccaatactatcttaagataattagttgttaattgctcaacaatacgcatttcaataacaacaataataactgttaatattttctttaacatataacttaccaaggcttggatgtaaccaatattcacccctccctttcaaatgtttgatgtggtagatttaggtaaatgcattcagttacacaatggcaaccacgatgtgcgtaaagaacatctcttttaccctaaaaagctcacttatgtccttttgcagaaagcacgccttccaagcacagcctctgataactcttgatctgttttctgtctctgtatctatatctaagaagatatctatatcttctcctgtgtggatttatagatagatggatagatgatagagagagagagagacagacagacagagatagatagatatggatatggctgtagtaaaggtaaaacatatttatatctatagctataatatttatctatccctatggatctgtagtatcttaaagtcatgtctatatcaaatatctatattaaagccatatctttatctctctatgttatagataatctagatatatctatatagattcacacaggatatcttctcaagaatgttgcagaaatagaattattgataaagagacttgatcaaactttcaaatataacgttttctttgtatctagcttctctcactgagcataattcttttgaaattcagccatattgttgtgaaattcagccatcaatagtttgctttttgttattacagaggattgctttgtgtagacagaccttaatgggtttatcccctaattggcgaggtttcttttttgccatttggctgttttatatgaagcttttataaatagccatacacaggctttagtgtggacttactttcatttatcttgagtaactgtctaatgctgaaattgcaaggtataaataaggtgtatttgacttttaaagaaattgttttctacaatggtccttccaaaaacatcagtctctcatcaatcaggtctgagggtgttttgtaccccagatccttcaaaacctttgtatgtgtcttttgaactttaaatttgagctatgccatggagctggtagtattccatgctacaaagggtgcagagcatatttttatatgctttttgattactcttatttaatttgtatgagtgtgttttgatggggttctgcaacaattaaacacaatcagaaaaaagtcacataggatatcaatatatattatatttatctatctgtctatctatattaaagtcacctctatgtctatgtatctatgttaaagctacacatatataaatatataaatatatttgtgtatatatatggatacatttgtatatatgtgtgtgtatatatatatacaatctgtatatatatatgttgatcatatatataactatacagattgtgtatatatgtgcagacataatttatgtatacatatatgtacacacacacagagacaatcctagccacactagcagctgattagatggtgcccatccaggttgagggtggtcttcctctctcgctccactgactcaaatgtcagtctcctttggcaacaccctcacagacacacccaagaacaatacttagcattcttcaatccaatcaagttgacactcaatattaaccatcacagttaacaaactatggtatatatgaccatgtctggttgattaccattttttttgtaaataatattttatgaaaacataaccatgtgcattcatttacatctttcctgtggttgctttgcatgactgcaatcagttgtgtagctgcaacagagatgcatggcttgcaacattgaaaatacttactacgtgcccctttccaggggaaaaaagttgacccctgctatatattaaaatagcttattgattttcataatacactgagaaattagacccaatttataaatgtttgacttagaattccatattctatcatctaatttgaatgctaagtatagatccatttattctatgcactacttttatgtcttagcatgtaatcagaggccaaaatttaaagatgacactgtggtgagtaatatggttgaagatccagttggtctaaagaaaaggaacaaatatgttcacagaagtaaatgtgaaggttctatttttaaatttttgaaatttggggctgttttctacttcctggtctatttttgaaaccagtgaaatatctctctggttccctgttagttatcacacagaacttaaggtagtttcttctgtaagaaaaaaaaatgcttgtcctattattcaaggtaagtcccactattaagaaaaagaacgtttgtgtttatctactttctcgggattaataattaaccatgctcataatgattcctatactgtttattgggtttgattatttaaaaaatcctattgtacttttgagaagcatgttgtattaatttttctatcactgcagaacaaatttcccccaaaattagcaactgaatcgtcaaacagctatcgtctcacagtgtgtgtgggtcataaatcttggagtcatttcatggggtggtttgtggccttgggtcctatcgggggaacccacccccaatatttcaatgtaggttctttctattttccataagtgtcagctgagaaataaagagaaagagtacaaagagaggaattttacagccgggctgccaggggtgacatcacatatcggtaggaccatgatgcccacctgagcctcaaaccagcaagttttttattaagggtttcaaaaggggagggggcataagaacagagagtaggtacaaagatcacatgcttcaaagggcaaaaagcagaacaaagatcacatgcttctgagggaacaagacaaaaggcaaaagcagaactactgataagggtctgtgttcagtggtgcacgtattgtcttgataaacatcttaaacaacagacaacagggatcaagagcagagaactggtctgaccacaaatttaccagggcagaggtttttccccaacctagtaagcctgagagtactgcaggagaccagggcttatctcagtccttatctcaactgcataagacagacactcccagagcggccatttatagacctccccccaggaatgcattcctttcccaggatattaatattaatattccttgctaggaaaagaatttagtagtatctctcctacttgcacgtctgtttataggctctctgcaagaagaaaaatatggctatttttgcctgaccctgcaggcagtcagaccttgtggttatcttcacttgttccctaaaaattgctgttattctgttctttttcaaggtgctctgatttcatattgttcaaatacatgttttacaatcaatttgtacagttaacacaattatcacagtggtcctgaggtgacatacatcctcagcttacgaagataacaggattaagagattaaagtaaagacaggcataagaaattataaaagtattatttgggaactgataaatgtccatattaaaatgaaatcttcacaattcatgttcctctgccacagctccacctggtccctccattcagggtccctgacttcccacaacagggtcccccattaagtaaacatcaagctttcagttatggatgcagccatgggaaacctggactggggttgagattctgctgccacgcccagtcacatggctgttccaacagaagaggcctcagtttccaatcaaatgggctgctacacaaggctgctcaggatatggtagctggcttccccagagggagtgctgatgggaggagatgggaggagagaaaggatggggagagagagagggacagagagacagagagagacaaaaaggcagaaatagaagaggggagagagggaggaagaaacagagtgacagaggtagacagaaaaagggagagagaaacagaggaagacagagaggttggggagagagacagacagagatagagggagagagagaaaaggagaaagagacacagacagagacagagagaggaggggggagagggaagagatggagagagagagagaggcagagagagatggagaaacagagcctaacaaagagagagaaagagagatggtggggaagatacacaaggagagagagggcaagagagagacagagaaagagagggagagtgacagaaagggagagagaaagagacagagagaggaggggacagagagagggagagagagatgagagagagagaaaaagagaaaggagagacagagaaagagagaaagatagagagggaaagagacagacagacacagagaaaaacacagaaagagaggcacacgtacacatacagagaagaggacaattgcaaggttttttataatccaatttcagaaatgccatctatcacatcacctctaccttattttagtacagtcagggagggctggctgtacagaaggcatggcaaatggtaccaggaggcaggggtccttgggaactcacctggagacatgggctcatacaagggcaagttcatttcctaaaagtgttagaggctaagagcattaggaagtaacttggtgttcttctccttcaatgatgccaacaggaaactgctgtcataggatagctattgtacgctggtgtgtcccaatctccacataagagatgagaatgtcttgcaaactcagctcccaaaggggcggacacataattgatggtttttactaccattcagtagaatttctatgaagagaactaaatatgtaaattgaagaaattaaaaataaggctgatagtataaaagactaatttgacaagtgaatgctgtggttgggaaacctcattttattaccatttgtcaatgttttggatcaattcagagattagtgattttaatctcttgccagattcgggtcttgccatagaggattacaacagaattggccatgaatcattttcttactatgaattagtatcctatttatttaataataggaataaagcaacaagaaaaacaaaaatagtggcaattgacaatataccaagattttaaagtccataagtaatgttcaatactgctctgttttgtatactcacaaacatgcacctcacaatgggggttgaagtcataaaataacataatgaatataaattttatattatttctaccatccatgttcactatttggggagaaaatgactttattgaagttaatatttactttcaaagttctgttttcttttttttttgtttgcatgttttcatacataacactctaatttgcttttttctgccaagaggttgagagaaactacagcattacagctacgatattttgtctgacaccaaggaaatttcaataaactataatggacataatcaaatgatttgataaaacatagcatgatagctatgaatgttttcaaattattatattttaaaattatattacccaataaaagatatcaaggaccactgctatatgcatatgtacttgaaaacatttcattaatttactaattacaggttacatttttctcttctgttatctgaaaatgttttatgtaaaatttattgaaaataatccagtgattccaacatttagcacaaaaataagataatttttaaagtaatgcttccttcatagtaacttacatttgccagccttgaaaatacacctaacatatctagaagttgtttcttgatgaaatctgtgaatatgacacacattcataccttttattttatgtctcatcaaaaattaatagtattcatctatctctgatcctgccacttctttctagtatgacttcagttttgctgggaacttttataacaggtaagcaagtggtaacattttcattcactttttaacaccaatttcaactaagccactcaaataaacaaaggcttttatttggaagaattgctgtggaaacattaaacaatagtatccttttaccatctcttaaaaattgtgacgttttcaatatcaaataaactgttttagatatattgtacccatatgaacgaaatggccaatggaggtttttgttttgttttgttttggttggttttggtagagaattgacactggtgggtggaattgtccaaagacacaaagtcaaagtatacttggcacaagaggtgtttaataaaagtggttgcatgatttagtttatcaagtgcttagcttattatgaatattattccaggtattgttggaaaaatgaaaaccataagctactttcctttcttataaatatttgctatatatttaggaataaggtagcaatttttttctttaaagagccagagagtaaatagtttagaaatttcaatagatgtaatgccctcaacttggcaagctattgttctctctgaaggactagctggtagttttgtttgttttgtttgttttacattttacatgttaaaatgtccaaaccactcttagctcacagccaaatttgtctctccggctgttaataactgctatacaaagaggaagaatgcatacacacaagaaaattagaataaagctgaaagtgcttaccagaaatagaaatccttcatccacagtttgagttggaattatctgtattccagtcccacaatagggaaaggaaaaacaaagaagagggcagaagaagggcttcctttctcttttaatttatagaaggtttcctgcaagcttttatattggcatttttcctttcacccctttgcaacaacttagccccctgacctcagctagcagcaacgcagaccggagcctgtctcattttgaactgctgtgtttgaactgcccagctaagaaatctgtttttgtttgttggtttgtttgtttcagtttgcagaatgagcgtccatgtgacacacaaaaccctgactcaaaaatcatgatttggatgtttatactcgattctcacatccagatttctatttgtttgatagtaagtttcttataatggagtatcacttttctaataagttcttgccactttttcgttagagggagactgtgttcagcaggtgatatttgatagtggacgctcatttgatatcgttctttggtttgtagggtttattttttattttttggtcttagatttcctttttctctcagtggaacagcattttcaaggagtcttttattcctatgaccagcttttcttggtgttatctctttctgcttcttcactggccttatcttttctttgcaaacttgaacaagcaaaatgcaatgtattttttctttccaatccttgcgttcactgctatctactgtaagctatcatttaagctatctttctttgaatgagagttgagctttggcaggggtgcaagagagaaagcctatcttatttctttaccgtgatttcattgcagcaagctgaggtctcttaattttcataacctcttaaactgtctcgtctgcacttattttacaggaagcaatctgttccagataggaacaagatcctagaggatcattttttaatgagtgttatgtattctatactgcaccctttaaccaaatttcacataatgactgaggtacattccatgaattcagttaatgttaattttatttctttaagtacgaaatggatgagggaagatagatgttacatcttatatttaattccaaaaaggctctaaaacccattattatacatattattattattatttacaaaatttggtatccggacttgtgttgttcaataatagcaatgaaaatgaaggccagaattggaatacagatgcagaaaattcccttctgaatttaacaccatgtttcaattactagatttctttaacccatttatgtgtttgcaaagaattccaaaaatcataaccacttataattttatgtttctgtttctcatcttgttgatcaaatccagactgaaacaatttttttgaaactgccaatcctgttgacattttgttggaatactttctaattccctttttatgtcgcttgccaatcaggtttaatttctaaaagccatttagttcaacataaaaagaactctttcatctgaacagcacgccaacctaacatcttcttctctctctttttttctttgtttcatctagagtttaaagagaaaaattgagcacgatttcttaatataaaaaaaaaaaaacacccaacagacagacattggccatgcagctgaggagaaaagaaggaggtgaaaactgtggggtcaaagatgtaataagacaggagataattttttttctcatttataaaatggggttttagtgacatttatctgtctgatagagacctgaatttctacccaattttgttcttcatccactcaagatgaattcatccttgttacatcacactacagctagaatccagggtctcagggaaattgtggtatctctttttccataacagaggaaataagatttgccttctatgcagttcattaaactgaggatgttcataaaatatcttggtttccaagtctgcatgttttttcaaatagccactggactttctaaggaaagggaaaccaggatgtccctctgggttcagtgtggacctgcttggagaagggtaggtgagttggtatctccaagaattctgagcaggttgacttcttcatcatcatcatcatccttgggcatgcatgaatgctgaactgtggtctttaagaattaataatagttattttcattcatgagtaattcgtatacaataatatccaagtttaaaattcacatttaaaaatgtagaatttgatagattctgagaaatacgtgtatacatgtaaaaatcatcacagccaaggtataggccatttccatcagtcaaaaatatggtgtgggcccagtgtggtggctcacacctataatctcagcaccttgggaagctgatgcaggagggtcacttgggcccacaacaaattgagcctggacaacaaattgagactccaactctacaaaaaataaaaaagttagccatgcatggtggcacacacttatagtcccagctatttgggaggctgaggtgggagaactgtttgagcccaggagatcaagcctgtagtgagccatgatcacaccactgcactacagtgtgggtgacagagaaagaccctatctcaaaaataaatgaataaataaatatattgtatatgtcccatggctgttgattaccacaactccctcctagtctgcaacaattcctgagtcccaagtcactagcttttgtttgtcaaggatctcatattcatgaaatgaatcattctcttctgcctgcctggtatctttcacatagcataatgtttttgcgtgtgatccatattggcatggatatgagtagtttgttctttttatcattgaagaggatttcttcttatggatgtagtcactagttgatggacatttggattttttccagtttctccttaatatggcttcaactgacctgaacattcatgtgctggtctttgagtagaagtatatttttatttatcttggataaataaatagaagaggcactgcagtgtgatatgtcaagtgtatattgaactttactgaaaaatgtcaaatatctttcccaaagtggcttcctaatattacatttacaaattgcatgtgtgagttctaactgttccacactttcaccaacacttaatatggtcagtctttttaattttagccactccaatacgtgtgtagtggtcactcattgttttaatttgctcttcttaataactaatgatattgattacacttcatgtgcgtattggtcattggaatattttcttggataaaatgtctggttatatcatttagccatttcatttattttaattgttttgcttttcttcttattgtttatttgtaagagttttttaaatatatatattctggtaaaaaaaaaaaaacagaactctttgtcactttatctgttatttatattgtaagctttttcctccaatttgtgggttaacttaccatatccttaacagtatctttaaaaaaaatgttttctaaatcttaatgaaatacaatctattattattttcctttatggtccatcttttttgtgtcccacttaggagatattttcctaatcaaaggtcacaaataatttttcttacaagaaatgataatttcctatagaaaagttatagtttttgctcttatattgaaatgttggcatgtgtcttttctgcttcaattatttttagccagtgattcttactattatcatgtaaatatttcctcttattctgttcatatgtggacttaaactggcatattactgagtgcaaccttatatttcaacaataaagcccacttaaccaaaatagatggtcattattatacattgctgaattctagttactagtattttgttaaggatttttgcacctatgttcactagggatatgaagctatagtttactcattataatctttattattattatactagcctcttaaaatgagttggaaaccctttttttaatcttttctttccatttgattttgcatgtactcagtattattttccccaattttttaaagttccacctaataagccatttcttcctaaaaatttctttggggtacactttttactgcaaattccatttgttgaatatacatagggctatataaactatcttttttttcttcctgtgtgagttttgtcaatgttccctattttttcatgtcttttttcctcaaatagaatagttagaaatgtatcaattttattgaactttcaaaaaaccagcttttggtttaattggttttctctattgtttaattgctctttctctcattgatttctgttcttacctttattatttctttccttccctttattttggatttaacttgctctcatttcactgatttttgaagtagaagctcagatcctttatttgagaccttccttcttttttaatataggtatatggtgatgtattttttctttctctttctgcacaccacaaattgtaatgttgtgtactgtgttcattttcatttaattcaaaatagatcttaaattacaaatcccatccaagttcaataatctttatgagaacaatgaatagaaagagaaaaacccaaataaaataactaaagaataaaacattaaaaggaaaaaaaagttaaaactttggtgattttctgcaaaccattagttccaattctttttattttttatttttatggccacatatgacctaggaatcccactgctcagtatacacccaaaaataagcaaatcagttactgaagagatagctgcactcccatgtttgctacagcatgttcacaacagtgaagatttggaagcaacctcagtgtccatcaatagatgaatgaataaagaaaatgtgctacatatacacaggggagtactattctgacataaaagagaatgagatcctgtcatttgcaacaacatggatggaactgaagtagattatgttaagtgaaataagccaggcacagaaagacaaacttcacatgtttcgcgtatttgtgaaagctaaaaattaaaacaattgaagtcatggagacagagagtagaaggatggttagcagaggctgggaagggtaatgaggcagtggggaagtggggatggttaatagatacaaaaatagaattagaaggaatgaataagatctattatttgatagcacaacagggcgactacaggagctccaattcttgtgtaagaaaatggcaactgatgaggactctgcagtcattagaggtagcagacccggatcagattgatgtcacatttccaccaactgttcattaaccaacttccaccaagtgtctggaaatgcctgccaatcccagattttcacctagtattttcattgttgatcgtcagggaacagaaagataaattataaattggagtttcaagataaaaactcgatttgaggtttgacacaaacaaagatttctccactgggtttctttctgtttcatttactccctacagttcagctcagattaatgggctcagagacggattgcagtaattactctaccctgtcactctggtctgttatgcaaacaaatgtgttggctggaacaacagagagctcagaccagtttgacactacttacattgccttgtttcctaatttatattgtcctgtatgcaagacccatctctaaggctgacaccaaagtgctttctgcaggtgtttttaggctaagttctttatcttcacttattcctgaggttggttttttttgtttttttaacttgaacttgagattttcattgaaaggcataacttgattgttaactttagttcagtgaacactgtttctaagcatttacactgagtcagtaccctttttgggaggggggaaggtgtcctaagttagaattgtagatattttaatgaatttatcaacctacacacagtttcttcaatcttgcaatactctcagtgttgcagtaattatatttcagatacagatttctgaagacatgtacatcataattgctgcagagataagaaagtggtcattgtcattaataccacgtttgccatggaattcactttcaaattgttttaaagtacctgtgaattcttggatcatttttaatggactctccttcatatattgaagtgaactttaacttgacttggctccaatgttgcaatgtataattggaagaaattgattatatcaaatagatctctacatcaaactgtcactcacattttcaaacttccttcttctgtatagatggcttgatataaaatatttattttagcagatactagtcatttgatagctagaaagaatattactaaaattgtgtggttatatgtctttgttaaaatcatatttatgtgtgttgaaatcctattatgcatactgaaatatttttcccataggttttgggggacaggtggtatttggttacatgagtaagttcttcagtggtgatttgtgagattttggtgcatccatcactggagcagtatacagtgaaaccaatttgtagccttttattcctcaccccgttcccaccctttccctccacgtccccaaagtccattgtatcactcttatgcctttgcatcctcatagcttagctcccacttatgagtgagaacatacaatgtttggttttccattcctgagttacttcacttagactaatagtctccaatcccaaccaggttgctgtgaatgccattaatttattctttttatggctcagtagcatcccattgtatatatacaccacagtttctttatccactcattgattgatgggcatttgggctggttccacatttatgcaattgcaaattgtgctgctgtaaatatgcgtgtgcaagtatgtttttcttttcctctggatggttacccagtagtgggataggtgggtcaaatggtagtcctacttttagttctataaggaatctccacactgttttccatagtggttgtactagtttacattcccactagcagtgtagaagtgttcccttttcactgtatcaacaccaacatcatattttttgattttttgattatggccattcttgcagggcatgttgaaattttaaaatgtagtatctgaaaattttgtagaagaaagatccagtaatgtcaatcataagtatatacccacaagaagtacaaacacatttttaaaccaatgcatatacatgatttttatagaattactattcaccatagtgaaaaggaggaacaactcaaatgcctatcaactgatgaatcaataaacaaaatgtgatctatccatataataggattttgttcaaccatgaaaaagaatgaagctctgacacaggctaccacatggataaaccttgagcatatcatgctctgtggaaaaaagcagacacataatgctacatattataggattccatttatatgaggtgtccagaataagaaaatctttagagaccaaatgcagattagtggttgccagtattttaggcaataggagaatggggagtcactgcttcataggtataagatttccatttaggctgggagtggtggctcgcacctgtaatcccagcactgtgggaggctgaggtggtaggattacttgagcccaggaggtcaagaccagcctgggcaatgtggtaaaaccccatctctacaaaaaaatttacaaattatccggggcggtggctcattcctgtagtcccagatacttgggaggccaaggggggataatcgcttgagcccaggaggtcaaggctgcagtgagccatgatcatgccagtgcattctagcctgggtgacagagtgagaccctgcctccaaaacaaaacaaaacaaaacataaccaaaaaaaaaaggagaggatggttacacattatgatgatgagtgtaccaaatgccactaaaatatatgctttaaaatggtaaaaattcgaaatta[175 bp omitted]gtggcgggcgcctgtagtcccagctacccgggaggc[137 bp omitted]gcataccacaattttaaaattggacagttaaaaaaaaaaaggtagaaagcagggttttgaggtatagacaaatttgttttttaataatcttggttcccacagtggagcagcagttcagttgaatctaaaaatgtaaagtatattttgttctgattatactgaataatgcaggcgaacaactaataacaacaaacgtgtttcttaaagtggtaataaatatctctatgagaagaacaataatcaggggaaaaaattggaggagtgggagaaaaacatccctgccaatttgggagccaaaaattagcatcatggattccaaggttatagaattttaaagcaggaaatgtgagttcttatgactcctctggtagttcctttaacctcttgattctttaccaaatatggattatttcatgcctggtagcaaaagttcaacatatcggcatctacttagtgttagatactttcacagtaatatatcagttaaatttcacacacacacaaagctgttggggcctgtgtttactttgtaaccataaattgatcacatatatatatatatatatatatatatatatatgaaaactgtaaaatatattttttattatttcaatagtttttgggggtacaggtggtttttggttacatagataaattctttagtggtgatttctgagattttggtgttcccctcacccaagcagtgtgcactgtacccaaggagtagtcttttatccctcacttcctaccacacttccccctgagttcctaaagtccattgcatcattattatgcctttgtgtcctcatagcttagctcccacttataagtgagaacatatgatatttggtttttcattcgtgagttacttcatttagaacaatggcctccagctccatccaaattgctggaaaggccattatttcattcctctttatggctgagtagtattccatggtgtatacatacattttctttatccactccttgattgatgggcatttaggttggttccacatttttggaattgtgaactgtgctgctataaacatgcatgtgcatgtgtctttttgatatgatgactttttgcctttgggtagttacccaggagtgggattgctggattgattcgtaggtctacttctagttctttaaggaatctccttgctaaaaactgtaaaatgatttaaaatggcaatcaaatatgacttctatcatttaagtcaggctaagataagctatgatgagtttttcttcatcttgaatgaatgtggatatactttttctaatagtttgacatttttagtcatgtttcagtaaaagcttatgaatcctggtttgttttcatcaaggcattgaattccctgtctttgcagctgtgaagacaaaggcaagaggataattcggtagaatgttggataaatggttgaactaggagacagaaacatagatgaaatcatcattaaccttccaattccagaaagaatctgtttttctaagtattatatctatatttttattgaaacagattacaaatatggttcaacagttcaaggacatgatttttccaaactagatcagtaaattttttgaaaatttataataaaaaatggtatgaataaagttggggaaaggatttggaggtttataaatggctggatattaatctttcacttaaaatattcaagtctggagaacattccttgtggttataattggtagagtcaaatttttcttttaaaaagtagaagaggcttaattttctcaactttttgtttttagcattttatgcaatgagctactttccacaccagatgttttcctggctctgtttttatttgatttccatcacctgtgcttccttgaaagcaccagaggctcacaagctggcaatactccatcatgaactaaaatttggtcttgtgcctatgctacctcaatcctgacgtctcactcaaaggacagtgcctagtccaaggtttctgaactcagccaaaatatgtacttataaagaattgaaaatgttccagcaactcagctcagagcagttgatgtggaaaatatatttatggaggaaaactacaaaaaactccctgaaatggtattggtcttactagactaaattctaatacagccacagtctttcacatcatttggggcaggggaggtcaatgttgtataaaaatattgtcactctagtccattaaaatcgttcataaagatactccaataagttttaaaactgtacatttcatgacctctactaaggccatggaaaccttgaactgtgtagcagatgtaaattttgctcttcaacgtcaggcataagcaatgaagcattgttttaatgttcttggtcataccttgctatgaatttaaagaaatttgcctaaaagggggaatgtctacattcagccacagatgttggcgaagtgagcctgagaaggagaagttttcaatagctttgtccccattcctgcaaagtgaagaagagagaggatgtaggttaaacataatggtatggtctaaatcaagcttgttcagccccgcagcccacgggatgtgtgtggcccaggatggctttgaatgaggcccaacacaaattcataaactttcttaaagcattatgagatttttttgtatttgtttttagatcatcagccatatttagtgttagtgtattttatatgtggcccaagacaatgcttcttctcccaatgttgttcgggaagccaaaagattggacaccctgggtataaatgtctattttcctctaaaattcctatgttgaaatctaatcccaaggtgatggaattaggatgtgaggtatttgggagggtggttaggtcatgagggtggggcctcatgaatgggatcagtgcccttataaagggaccccagagagttccctcgccccttccaccatgcgaggacacagcaagaaggcgctgtctatgaaccagaaagcaggtcctcaccagacatcgaatctgccaagccttgatttggactcagcctcataaaccatgatcaatcagtgtctgctggttataagtcacacagtctgtggttttgtgctgtagcagcccgaatggcctaacacctataatcatgctccctgcaagtagaaccagaaatacatctctattctgacttattagacctgtgtctatgtactatgtcttgataaccagacccacagatatgtaggtcaacatccaagcacagaagtggtatctgtttcagtgccaatcatatgatgacaggaggtagatgtgtaagaatcaagccagctgcagttccatcagagttaaaggacattataatataacatacttttgtaattttcttctctgaattcaattttatcaaaaatatgttgcattacctcagacatttcaggatcaaaccttctacaaaaggatatttatttaaagcaaataaaaatccttgtgaaatataaaacccaagagaaccgtgcgtaaatcataaatcagttcatcagagagaaatactcaagtgttgtgtgttttgtgttttaatgagaatccctctctcatctactggcttgtgctcttaaataggaaaataaaatcttacacttttaaaatagtatggactaaacactccatgcatagaaattgttctcaaattccactttaattaaaagggaaatactgatgttaaactttaatttaaaataatttgaacacttcttttgatgatctgctgaatatatcactcatcataagcacatttgtactgattttcaaaatttcttgtactgtgttaatttcatggaggctgtaagtatttggtacggtgcaaagatatttaatggttcttatggatactcctaatgtcaggtaaaaatcaggaagcacctacacacacacatgcgcacacacacacacattgacattttttcattccctgggagatcatagagtctagatttaatgttggaaaatgaaattctccttcaacattcggtctaattcatattctctcatttgtgagggatcatttctgccagggaattgtcaccacggtgtctaactacatcattccgcgagtgctatgttctcagatggttcaagaaagcccataaaatcaccactgacttcaagtttgagatgccttcagatatccagtgagacctgatagtgtttaacctttcagaaaagccatgtatagagactagggaagctttggcttgacgacagtggcacaagggcagctattatgagtgacagttgaacgcagaggaaaaaatgagccatcagagggatagcaagaagagttagaacggaagatgaagatctgtgggatataaaatacgtgacaccatttaaaaagtcagaaaatccctgtgtagtggcttatgcctgggagggcaaggttggaggatctcttgaggcaaggaatttaagaccagcctcggcaacatagtgagaccctgttgatacaagacattttaaaaattatctgggtgtggtggtgcacacctgcagtcccagctactcaggaggttgaagtgggaggattgctttagccaagcccaggaggttgaggctgcactttgctgtgatggtgccaatgcactctggcctgggcaacagagaaagattccatttctaaaaaaaaaaattaaaaaaaagtcagaagatgagtcagagctatcccagcaacatgagaaggtcccatctcttaaaaataggaagtgagcaaagaagagggttaaactacaaaaaatttgtgtaaacacatgctgaatagagggtatggcatgttaattacagtgaattgaacccatagataaagtgagcacagacattcatccctgatgccaccacagtgtctatcacagcatgaagttctaattcctaacaagaaggcatgtatgattcacaagagaaatcaaggataaagacaggttgtagaaaaaaaggtgaaggatgagtg[142 bp omitted]aaccccgtctctactaaaagtacaaaaattagccaggcatggtggcaggcacctgtaatcccagctactcaggaggctgaggcaggagaatcgcttgagcccaggaggcggaggttgcagtgagtcgagatcacgccactacactccagctggggtgacaagagcgagactccatctcaaaaaaaaaaaaaaaaagttgttgttgctgttattgtatttttgtattttgagttgttaggactgttgattctctttgtaaattgaagatattacttggggatatttatacataaaggagaagaacagaaacagaggtccagcacagtgtctatcacagcattaattcctatttcctaacaagaagacctgtactattcacgagagaagtgaaggataaagacaggttgtggaaaaaaaggtgaaggatgactgaatgtagcacgtgattcaggtggatttgagaaatttattgttgctgtcactgtattttgagttgttaggactattgattctgtttgtaaagggaagatatgacttggggatatttatacataaaagagtagaacagaaacaaatgatggaataaggatgaaaatagaaagaatgcagggagtaaaaaaccgtgccaagggaacagcaagcctaatttcatccaacagctttctttttgagacagagtgtcactgttgcccaggctggagtgcagtggggtgatctcggctcactgcaacctctgcctcccaaactcaatcgattctctgcctcagcctcctgagtagctgggattacaagcgcacgccaccatgcccagataatttttgtatttttagtagagggaggattttgttgtgttggccaggctggtcttgaacttctggcctcaagtgattcacccacctcggcctcccaaagtgctggaattacaggcatgagccaccgtgcctggcctcatccaacagcttttatcaaataatgtgtagtagagtttattctttccttttactctggtgtcaaatgaaaattttttagtttttgatttttttcaagatagagtctctctctgtcacccaggctagagttcagtggaatgatcatagctcactgctgcctcaacttcctggggctcaagtgatcctcccacctcagcctcctgagtaactgggactacaggtgcatgccaccatactgggctaatttttccatttttagtaggaatagggtctcactatattgcccaggctggtctcaaattcctgggctcaagagatccttatgcctgggcctcccaaggtgctggaatcacaggcataagccaccacatccgggtgaaaatttttgaatgtcgtgacagcaacattggattctcactctcagcctttgccaaatgaccccgtttgtaggatagggaggctgtgtccaaatacttgattgaaatacagttaacttaagaggactttgttaatttaatttataagactctttggaatttcagttcttgaaatcaatgcagaaatgcaaattacattgtagaaaattatctgccattatgctaaatcgtacagcattatatttatgaccagagttttctgtaaggagcaacagtaattaatccttcattctgagcaagaagtttcctgcaatttaagtttctgtgggcaaagaaaacatttgctggtggattaaaagaatctgtcagtttaacgtataggggatgttataattgagaccaaaatattaagaagcttatatatgtaagctgaatctcttatattatactatatgttagtaacaaagtttattttatggagaaataatttatcagaaaatgtcttgttttataaactaaggttcatttattgttttaaaaggtaaattaaaatgattaaattttggtgagaatgaccaaagatataaaataagtgaaatgatataacacaaataaaaaattgataatttctttgatatctaccgataaaaatgggtatactatgtatccctattcatataaattaagttgttttttgttggggttttcttttcgtggtttttatttttttgagacagagtctcactctgtcgcccaggctggagttcaatggcataatctctgctcactgcaacctctgcctcccagttcaagcaattatcctgcctcagcttcctgagtagctgggatacaggtgtgtgccaccacgcctggctaatttttgtatttttagtagagacggggtttaccatgttagccaggctggtctcaaactccagacctcaagtgatccacccagctcagcctctcaaagtgctgggattacaggtgtgagccataaattaagtataatttgaactggcaacatctaccctctttttttattagatgtattcatcattaaatggattaataccagtttattttatagatgaaagcaaacaaaaataggaagtgtttcgtgaacctggtaaataaaccttgaatatttttctttttaattgaggtattttctctttcttcatgtcatgagggaaattctcgattcaaacagaagaaatctatttgtcaaaggtattgcaatcataccttaaattctttaggcaacagagagttgaaggagactgtattagtccgttttcgcgctgctgataaacacataccagagactgggaagaaaaagaggtttcattggacttacagttccacatggatggggaggcctcagaatcatggtggaaggtgaaaggcacttcttatatggtggcagcaagggaaaatgaggaagaagcaaaactggaaacccctgaaaaacccttcagatctcgtgagacttattcactattatgagaatagcaccggaaagaccagcccccgtaattcaattacctccccctggctccttcccacaacacgtgggaattctgggagacacaatttgagttgagatttcactggggacacagccaaatcatatcagagaccaaaaattctccttaaattcacctccaattttagtttggaatttcaggaagatggttggtttgtgtttcattctctgacgttgtaggcttagtagcttcctcattattatagcctgggatacagatgccttaacctgctgtggctagttgaagatgtgttcacctttagagcaaaataattcttcctgaaatcaacctaatctcttcaaaatcaaatcttcaggaaaattatgctttacaggttttattgctagatcattcttcacctagttctctcatttatacattcaattagcagatttgtttttctttagagacagggtcttgctctgttgcccaggctggcattcagtggtgtgataatggctcactgcagacttcacttcccaggctcaagcgattctcctgcctcagcctcctgagtagttgagactacaggtgcatgccaccactcttagccaatattttaattttaatttttagtaaagtagttttatttttaggcaacatagcaacacctagtttttatttttaggttttgctgtatttcccaggttggagattatttctcttaagctttaagtctgtaatacagacatgtgggtctgttccttaactttctttaatacagagtctatctatatcttgtctatatatctctatattgctatagagatagattgctaattggtagatgataagtatataaatctggatagatacataattgatacatagatgatagacagatacatcctttagtctaatcaaaataagtggtacacatctgatttctaggtggaatagcattattttctggtgtcagagaaaccagtgatttaaaagtaagtatgaactttcaatatcttagtttcatgcagattatgttccttttacacttcttggttcatcagaaacatatgctgtgcgaggtggaaggatgtctgattacagggtataaaaccttcagggtgaaacatatttcaataccttattaatgtttcaagctccatgtctttttcatggctgatgcatttttgaatgttatgaaaagctttaatggaatagaagcacaaaagatggtaaacaaaattatcttgtatttgagagatacataaatcaaattttgtagatagaggttgaaaactgttactatttttagggagataatgttattggcttgcagtcatctttactcctgttcctaattatatcgttctttgagttggtactaatcctattgcccagctttattcaggaaattttgcacccagaaagcagttgggcatttatcttataattaatgaagctgtctttcatttgtgctacactttgaattagacagaagaaagcctgtagatgatttctgctagaggataagtagatagctttgacatggttcttaccctgtttgttgcatttaaaaagggcaggagtggttcagtgacaaatggaaataattgtcatgctgcactatgcacatgtatccaatataagaatcatttcctttgtaaatgtactgaaaaacaaaacacacacacacacacacacatacacacacacacacacacacacacacactgtattgatctgttctcatgctgctaataaagacatacccgagccggggtaatttatgaaggcaagaggtttaatagactcacagttccacatgtctggcgaggcctcacaatcatggcagaaggtgaatgaggaacaaaggcaagtcttacatggtggcaggtaaagagaccgtgtgcagggggactgccctttatgaaaccatcagatctcatgagactcattcactatcatgagaacagcatgggaaaaacctgcgcccgtgattcaattacttcccaccacgtctctcctgtgacagtgggaatgatgggagctacaattcaagatgagatttgggtggggacacagccaaaccataacacacacacacacacacacacgtgcacacacacccacccctccttttgcattactccttcaaataccgtcattctgtaggatcaatcatttccattcgtccctcacaatctttccacagtcctgtggattataactttcataagggcaagttttgccattccacaaaacatttgccaaaaatgtagaaaaatgtataaatatatacgccataacattttttaggcacaatacgtaattattattattttttgagatggagcttcactctttttgcccaggctggagtacagtggtgtgatctcagctcactgcaacatccgccctctgggttcaagcaattctcctgcctcaggctcctgagtagctgggattacaggtgcccaccaccacgcctggctatttgtgtgtgtgtgtgtgtgtatttttagtagagacggggttttaacatgttggccaaattcctgacctcaggtgatccacctgccttggcctcccaaagtgctaggattacaatacgtaattttataagatagctgtatgagatgtttaataattgcctatatttagaaaaaaacatttttatagagtgagattcagtatctaattcattaaaagtcaacaagtgaaataagtaggaaatgaagaaaaatgcaaagcggttgtaaatagaggaggcaatataatattatgaatgcaagaacactggtatttcaattaagtatagaacaaggaggctgggcatgatgggtcacacctgtaatcccactgctttaggaggctaatgtgggaggatcccttgagcccaggagtttgagaccagtctgagcaacacagcaagactcactctctacaaaaatttaaagaaaaatagcttgatgcactggtatgtacctgttgtcccagctactcaggaagctgcagcaggactgcttgagcccaggaggttgaggctgcagtgagccatgattgtgccactgcagtctagcctgggtcacagagcaacatcctgtctcaaaaaaataaacaaagagcaagtaggcaagtagttggttaaatacattcagaggaaatagaaagaatgtcttaaaatatttagaagggaaaaacttgtatttgtcaatattttataacaattagcatccagcagtgaattcatatttaggacatgatgaatactacattgtgtttcgttatagaatattactattttttatttctcatgtgcgattaattaaaattatcaaatagtttatgtcatatatatacaccattgatcaacaaatatttatgcagctttaattggtgccatatatcatattattcattaaagagacagtgttccaattttaattgttctctaatttaagataagaaaccattattcaaaaagcaaaataaaagtctgtattttcaaatttgttcacatagggaatgaaaacttcccctctcaatggaaactcacatgataaaaattaaaagaaaactactaggcaggaattcacatgtatctttttatttataattaaaaatttgacaaaaatatctgtttgtcatactgaaaataagttacttaccagtttgtggaaaagacttggaggcttgataatttagtttcagacgcataactttccaatacatctttctgtttctcctccatgtttcttaaacaaatatttaactgctgagttgggaacagaacatcatttagttgactttactttttgtgaagatagtacagcaaaacattcttaatgttattttagagtagctgaatccccaagctggtaaaaaataagttcagtatttattatgcatatacttcagatttttaaattatttgtaacattattttatttcaattcataccccctttccatacatacatatatatgaatcaaagacatttattaattagccaaaagtcttaaggaatagcaatagaagcagtttctctgactttagtttgacgatcttctctgtatttcgtggttgccatttaatgaaatgtacacttatttgaaaaataagtgcaaaaaacttgaaagaaaaactttacatacatttattagcaagcatgaaaaaacattaatgttaccttacttgcctctagcaggcctttccaggggacaacttcacctttaaggaaacatcatactacaagggaaatgtttggaaaataataaaattgtatattttcccattaaaaatatataagaatgaaaatgccttcaaatttatatatttttgaatggcttggttaaatgggcagacttttcataaagaaagacgtggaaaaacaaataactcaggctgcattatttagccaaaaggttaagatgctgaaatatgaaagtctaaaaaccaaaagctctaaaagaaagaatttgtttgtcttccatttctgagttggtggctgtctcagttccacagagtcatgcagagccccaagctatgaatagcttcgtgattttcaactacattttaacaaagccccacttgttgttgagtccagtcaagttaggggttgggaagggatataaaggaggtctccagctgtttacatacccaatataagacctttatatactccatgtcggcaagctcctttttctttcataatctgggttggtggctggctcggttccacagagtgatgcaggaacccggactatttatggctttgtccatttcaactatatattttctgaaacctcacttgtgcttgattgtagtcaatctaggaggtgggatgagcatataaaggagggactccagctgtttatataccccatatcagctctttatatatcccatgtctgctagctcctttgtcttccacgatctgggtggttggctgtcttggttccacagagtgatgcaggaccctgggatactaatagctttgccatttttaacagcatatttacatagccccacttgtggttgattccatttaatttgggggtaaggcacaggtaggagaaattccagttttttaggtaccccatgctagctctttgtagactccatgtctgcaagtttctttgtctttcataatttgggttggtgagtgcctcagttccacagagtgatgcaggactccaagctcttaatagctttgtccattccaactacatcttttccaaacccccacttgtggttgatcccattcagttttgagggaaggcacaggtaggagaaactctagctgtttctatatccccatgtcagcaagagaagcacatcacttccacttgtaattaattagagagaacttagtcattcaaattactgcaacacaaattctgtcagcttagtctttggcttaaccatatccagctctcagctcataattagaaaagggagaaatagctttggtttatttagaacaggtagttctttgccatagaaggaacaacctgtggaatgaaacacctgaaagcagaaaactttctttggcggtatatttaattttctttggggtattcaaccgtaataggattattatagaactttgacaagttgatttatttgtaaaagaatattataatctgatatggtttgtatttgtgtcccttcccaaatcgcttgttgaattgtaatccctaatgttgaaggtggggcctagtgggaggtgaatggatcatggaggtggatttcttccttggtactgttatgttagtgagtgagttctcatgagatctggttgtttaaaagtgtgtggcacttcttcccttctctctcttcctcctgctctggtcatgtaagatgggcctgctctccctttgcctttcaccatgattattagtttcctgaggcctccccaaaagcagaagccgccatgcttcctgtgcagcctgcagaaccgtgagccaattaaatctcttccctttataaattacccaatctcaggaacttctttatagcagtgtgagaacagactaatatataatcatactatgaaaaaaatctgtaagagtttatccgttggtacgtggtttgtgttctatgtgaatcttgatagcataacctacctcaaggttgaaataacagcttcctaagatatttgtgtgtttacttataacaacagcagaacatcatggtgacatttttaaaaagtaatattcagaaagggacatgtctgattttaaccttttcagtaggaattggttacatgaaagtttggttgcaattcaaaaagcaaatgaataaaaaatgatttccaatactgcaattgtacccactgtgtttattttgctttcttttactatagaaaagaacccatagaaaacattgcattgagtctctgtcatatcaattatagagttgaaagctctttaccaactttcttaatagtgcagtctctttctgtccaaacatttttaaaatgcagtaactctatgtattactgacaagtactatggagtcctttaaaccaatcataatatgatgtttcatgaaaatgaataattcaactcatttttggatgttgtttcttcaaaaccttctttcaaaacaatatattgtctttaaagataaagtaaaaataaatgaagattccctgaagatggaggcatgctttctttctttttaaatgaaagaatgttttctactatgtgatttataaccaaatttagttctaagaagctgcatctatttatgtcaaaaccactcctctcatgcaagacagactgaacacctgaataaaaaccaggagttcagatgtatttctttgaagttatgacctattttatttccctgttgtgtaacactaactcattgtgacacaatctttgagggtttatatcttttataattaaattgccctgaagaaagttcccagtcacaatcttcattcttttcaaatttttctgcaatggagcacaattaagaataaagaatgcatcatgacacagtgaaaatgctaaaatttcttaaagaggtcaaacaagtttcaacattcatatcattaattatgctttgaagcactgtcctttctaagtgacactgtttttattttgaacaacatctaaattcagggaaaataatcacttctaaagactatttttagttgagcctgctttcttcgcccagtttctaatcagaggctctgctataagttgaatgtttttgtgcccccgaaattcatgtgttgacatcttaacccccaaagtgatagtgttaggagtgggggactatggtaggtgatgaggtcatgaaggtggagcctcatgaatgggatcagtgccctcataaaagggaccccagagagctccctcgtcccttccagcatgtgaggacacagcaagaagtcaccgtctaagaaccaggaagccctcactagacactgaatctgccacgccttgatcttggactcccagcctccagaactgtgagcaacaaatgtctgtagtttataagccacccaggctatggtagtttgtatagcaccccaaacatactatgacgggttctcatacaatttttcgaagattctttatcctcagtagactgatgcaaaactaacccatcaataatagagaaaaaaggagattgagacaaaagatgaaaaaatgtttgtctgattcctgttagaatgttgctaatttttccctgtagtttttttcaatgtatgtatccttcataatctctctctctctctcccttgctctctgtctcttgctctctctctcactgtctctcttttcttttctctttcttatatatctgctgctgctacacctatgtatatatttacataattgggaccatattatattaaatgttttgtaccaaaccttttcagtgaaagtcacatgataaaaccctcttttaatgtatttatcattgaggacttaagtgatttttaaagtttcggaatgctgtgaacaccctcctataataaacacaatttgcctctttgactcattacttagaatatattcttaggagtggaattagtgagtttaagaatgtgagctgggcgcagtggctcacacctgtaatcctagcgctttgggaagccaaggtgggaggatcacttgaggtcaggagttcaaaaccagcctggccaacatggtgaaatcccatctctactaaaaatacaaaaaaacaaaaattagctgggcatggtgtggtggcaggcacctgtaatcccagctacccgggaggttgaggcatgagaatcagttgaacccaggaagcagaggttgctgtaagccaagatcgcaccactgcacttgagcctgggagacagagtgagactccatctcaaaaaaaaaaaaaaaaaaaaaaaagagtatgaacgttttaagatatttgttacatattgtgaattgttctaaaaaatgtttgcagtagccagatgcagtggctcacacctataatgccagcactttgggaagatgaggcaggaggatggaggttgaggccaaaagttcaagactggtctgagcaacatagcaagactccatctctacagtaaactaaacattttaaaaatcagctaggtgtggtggtgcatgactttagtcctatttattcgggaacctgatgtgcaaggatttcctaagcccaggcggtcaaggctggagctatgaatgtgccattgtactccagcctagtcaacaaaatgagacatcatctcttaaataaatataatttttggaaaagttttcagcagtgcagattcccttgtctagtagttgtgttgattcaccttttttttttttggcaactatggtaattagcatttttaataaattcatttaaaaatagattttaagcagctgaatgtaaaaaaaagaaaaaaaagcagattaagttgttgaaaattgaagtgttaccttagctctttgggttgaggatgaataccatcagatttggggcctttcccactttcctgtcttacgtgtgaatgtctgggtacacggacacttcaggttaaggattctgtctccaacttttatttcctgataaaatatcaaatttgattttttcatttctgtgttttttttaggcataggaaaattatatatatatatttacttcccatgagaacacaatatgatttactctttttcttcttatagcaatggcatgatttcagagaaatatccttagtctctgatatggtttgactctgtgtccccacccaaatcacatcttgaattgtagtccccatgtgctgaaggtgaggcctggtgggaggtgattggatctcccttgccctctcacctgccaccataaaagatgggccttgcttccccttcgccttctgccatgattataagtttcctgaggcctcctccccagccatgaggaactgtgagtcaattatacctcttttctttataaattacccagtctcaggtagttctttacagcggcgtgaaaacggactaatacagtctcacactcattttgtagaaatctagcaactgtaattcgtaaaactgctatattgaagctaactggaatcaagcttactgctttcagcttcagaaaagcaaatcttagtaaaaagaacaacagcaacaaaaacagacaacaaagctgcaggtcgtgagagctgcaggaggtacttttagaggggaagggggattgttaaataatgagatctaggaaagcatcttgaagtccattgctgagagaatatttgaaatgtactctttgccaaaataaataattcactaaataaatttgttagttaattaaaatgatttctaataaaataattacttttttaaagtccacttactttaaacagtaaaaaagtctgtctgggaagctgctgtcaatgacttaaaaaaaacaagcctgggtgtggtggctcacgcctgcaatcccagcactttgggaggccgaggcaggcagatcatgagttgggagagagagaccatcctggccaacatggtgaaatctctactaagaatacaaaaattagctgggcatgattgtgagcgcctgtagtcctagctacttgggaggctgaggcaggaaaagcacttgaacccaggaggcagaggttgcagtgagccgagattgtgccactgcactccagcctggcctggcaacagagcgagactctgtgtcagaaaacaaaccaacaaacaaaaaacccaaaaacaaaacaaacagaaaaaaaaaaaaaaacaccaccaatagctatcagactagtcatatttccatatacataatttgtgttaattcaacatcaatatccccaatacagccttatgaaagattaagggaccaagaatttccctgatgctggactctgttctgtggcatctcccacacacctgtattaatttgcatcccattgtctttaacatacagaggaacttctctgctctgtggaatttgcaacatcaggaagcctcagttttccattctaacccttccacttcaaggagtgtcatatttccactcaattttactgattctaccattaaaaaaaaaaaaacaaacacattctattcttagttcagaaggatactaaagggtcattttatagttttcattttttagttattgttatctcttgccagattttattttaattcattttattcatagaattacatgttcctttacagtataaccttttggctatgttttatattacttcctattacacatgtaatttataattatatcctcactgtaaaaagaactaaataatacaaagtaatgtaaaatagaagactttcctttttcttattcccaatgaatttcagagatgactcctttaatcaattaaaagtttggctatgtatcattctagccatttcctttatttacatacatctgtctatatatacatacatttaattttttgaaggtaaatagaattctgatggttaaatttatatgccaattggctgggctgtggtgcccagttgtttggtcgaatagtctagacgttgatgtgaaggtacttttgtagatgggattaacatttacaatcagtagactttaagaaagaaaggcaacctttcataatgtggttggatttcctctgattgggagcaaaaggtgaaggttctcgaaaaagaagaaattccacctcaggagtgcaacataagaattcatcctgagtttccagcttgtcttgtagattttggattcaaggtggcaactcctgcctgaattcccagccatcgcggctgccctacactgtacagacttgccagtccccacgatcatataagccaactccttaaaatgcatctcttccttagttctgtctctctggagaacctggactaatacaggatcattgcatgcttactgcctgtgacatttttgtactttatatattgtagagcaggattccatgttactacagaatggtgtatgccttttctctgttgtaaaggatgcatagaattcctctgtttaggtgcatcatacacatacttattcatttatctctggatgggtatgttggctgtgctcaacctttctttattaaacaagatactgaagtggtttattcatgaatagtgtcatcttctaaaccattttacaggagagactgcaacaggagctggtaatcgaaaagaagcctattgagaaagacccccataacctgtgtaatctttctaaatatgattacaaaaaaacaacaaatgataccacacacatgcacacacacatacacacacacagacaaatgcacacagagaaccacaatttctatgaaattgtaacgattatatccatttttcttacgtacaaaaatattgttagatagaatgaataagatctgtagccattagcatgataggattactataattaacaacaatttattatatatttaaacataactaaaaaatagaagtggaatgctcccagcacaaatcataaatgcttgagatgatggacaccccaattaccctgattcgatcatcatacactatctgactgtatcaaaacatcagatgtactccataaatatgtacagctattatgtcaccataataattaaaaataaaaacattaaatgaaaaagtatataattaatatttaattttttagtattaaaaaattcttcaaaattctatttcaagtccagatgttgactgttatctcaattttattatctatatacatccaaatttaacatgctccaaagaaaactcttgattctcatcccctagaactgccttttttccagttttactacttgtgcatatgccactacttagtcgtcgaagcccacaagggaaggattatatgagattcatcttttccctaactctgtgcaactaatgcctcagcgagttccattggctctgcttccaaaaggcaacccacttccttcacattttcaacttcattcccatctgacattaatcccaaacatgttcagcttcccacctggtcactcttcagccaggatagcaaaattcaccccccacagagcagccaaggagatgcgtgtcaagcatacatctgattacatccttcccttatgcaaaatgtgtccattggttttccatttcatgtagaattgaacccaaaactgtagccagtcttgttgttgctgctgggcatactcctgtattagtctctctgtaaagttggtggttacccccttcaatcttgctatcattaccctctgcattttgggagtctgcactgaaatacagccttccctgtccatgaaattctaaacataacatttgaagcaaacatggaaacctgtcacatgccaatttagtgcacacatcttgaaatgatttctctgtacagttaacacagagtttttctttctagcagccagggatcagacttcaggatcccattttcttcctcatgtctgcataggaaaggaaataaatagaaatcgtcaaacactgataaggtgctcatgtctacacctctgcagagaagaaaaattgcacagctaaaagagcaatttggtctgcaaagaggcaggctttatactctcccaagactttatcatcctggacatataattcaagaaaaagtatctgaatggaagatacactggtggttgtttatccaaagaaaaagagaatgaaatggactctcatcgaagtgaaatggatctccagggtaataatcagtctcttctgctcctaaactttgagttatggaataaaaaaatgctgtgtctccctctgagatgtggaagttgctttctttgcctttgcatattataataattaagatttatgaggatttcacattacatttccacagttagacctatacaatattcttctccatagaaatcatcatcttttgaaatgacagcagtgatatatgaaactttacatggtagagagtccagggacttctctgctctttcaagagttttttaattgctaagtttagtcaatttagtgtaataaatattgattgaggacttactataaccaggctgtgctctagtcttgggtatatttagtgctaaataaaatataggtcttaccatcctgatagttgacagcagtggctcttaacaaaaggtgattttgcttctctccaggaaacatttggcaatgtctggagatgtttttggtctcaccagtgagggggagaaagttctaccagtatctactgcaaagacaccagggacactgccatagcatccttgtaattgccaggacagccactcacagcaaaaagtatacagcctcaaataccaacagcattgaagtttgagaaatcatattttacaacttaagggaaacaaggcatgtgtttaatagacttataaatcttacagtgctgtgggtatgtgtattagtttattctcttgttgctaataaagacatacccaggactgggtaatttataaagaaaaggggtttaattgactcacagttcagcatggctggggaggcctcaggaaacttacagtcatggcggaagtggaagcaaacacgtgtttcttcacatggtggtagcaaggagaagtgcctagcaaaagggtgaaaaggcttttataaaaccctcagatcttgtgagaactcactcacttcatgagaacaggatggggaaaactggggaaactgtccccatgattcaattatctcccaccaactcctcccactacacgtggggattatgagaagtacaattcaagatgatatttgggtggagacacagccagaccatatggatatgttagcagtggaaggtattcaagtcacacggcaccaacatatgttagtggtagcaaatccatatgagtctgcaacaacctcaattcttgcctcctcagaagaaagaattcaacagaggagcacaaggtagaaggagagactgaggcaagtttgagaacaggagtgaaagtttattaaaaagctttagagcaagaatgaaaggaagtaaagtatacttggaagagtgccaagtgagcgacttgagagattcaagcacccagtttgactttttgactcggggtttcatgcattggcatgcttccatggtcttgcattacttctctccggattcttcccttggagtgggctgtctgcatgtgcagtggcctgctagtgtttgggaggtgagcatgctcattgtgtttactagaggctatacgcatgctcacttgaagcatttttccttaccagccaaatgtccctagaagctcatatattcattaaactctgacattttgcctcttaatgtgcatgcttgagcccactagcccaactccagagatcttgttgggaagctgctgatgatccgtttcaggtgttttctatctggagactgcctttcgctggcgctggctgtgaccagtgattcttttggagaggtagttaacaaccgcctgatcatcacctgatggtcgcctgacattctggtatatttatgaagactgtaagggtgactacagaaaggaaatgcaattgtatttctattttacatttatggccttgaaagagtagcctggattttatgaaaagactggtatttaatgcaaggaacgaactctggagtcagatacctagtgtgtccagggacaggctgcccttagtttgagcaggaagctatatgtgcagtttgaggcatcttggcagatggacagcagcccatttcgggtactgacaccaggcactgagtgctatggctggtaggaggctacaggcaaagaggacattgcatggattgaccaccttcaaaactaacaacacactcaggtcatattccaggctttccctgtgcaaaaatctcctctttaggtagcaaggtagagttaggacatagtaattttacaagagtcttctaatgctttacacagacctgaatatgaactgaggggctgctaaatgatttcaagctttatcccttatcattgctggagagcagaccaagtagttaaagcttcaaatagctctgtgtttatattttatatgtcccaaacaaagtgggtagaatacctctgttgaacaaacatgtttgcattctttggatatatgtgaatttttcctatctgatgtatacatttagtattgatgatctctaataagtcgcaccgaatgccaagactcttcaaggtaattaggtacattctgaatatcacatagtgcccagatcgtaaaaacaaaaacacaaaaagaaaaccaagtatctcatattgtcacttataagggggagctaaaccttgggtacttagggacataaagatggtaacaatagacactgggatctctagagcagggaatgaaggaagagtacaaaggttgaaaaactacctattgggtactatgttcagtacctgggtgacaggttaatttgtactccaaacctcaacatcatgcaatatgcccatgtaacaaacatgcatatgaacctccaaatctaaattcttctttaaaaaaatagaatgctatatagaacaacaaatgctctaaagtgttgtcaccaccataaaacatccaaggtgcagtacacaaaaactcatctccatttccaggccaactcttatagggtgtttaagtcttaaaatgtaccctgcttaatttcagctgtacgtttatgtataaaatatagagtatattcatcccagcactttggtaggctgaggtgggcggatcacgaggtcaggagttcaagaccagcctggccaagatggtgaaacccgtctctagtaaaacatacaaaaattagatgggcgcagtggtgggtgcctgtaatcccagctactcgggaggctgaggcaggagaatcgcttgaacctgggagacggaggttgcagtgagccgagatcgcaccattgcactccagcctgggcgacagagcaagatttcctctcaaaaaaaaaaaaaaaaaaaaaaaaaaaaaagagggtatattctagagaatgggttttgtttaattagttaatgtgtttgattctatgcaatgttctgaagaccctttggtgatgatctacatacagtcataagataatagctctcttctacacatgccttactattatgacttgttcccagcttccagtgattatgcaataatagtataagtgagtattggtgtgagacaggagggactctccacttaataatttaaaataggcgttactcctctgtgctgcttttaattttaaatcactaacagtaagtaatgagacatacaaaatgtaagaactcatctatcttacccttgctgtatttgcacaaaagaataaatggacttggattttcattattccatgagatacctgtgaataaatacaactcaatatcatagagttgtagttccccaactgaaattataacagtggatatgattgttttacacaatctagagtattaagggagaagcaattttgctttcttaaaaggatgattttcttgggctcccatttggggatacagatacagagttttgaagctttttttcttttttaggatttatgcatagaggtgatctggtttttttgtttgtttgtttcctttcttttcctttttctttctttttttttttttttttttttttgagacagggtcttgctctgtcacccaggctactggagtgcagtggtgcaatcatggcttattacagcctcaaactcccagggtcaagtaatccttccgcctcagcctccctagtagctgggctacaggcatgaaccaccatgtctggctaatgttttcttttaagtttttgtagagatgaggtttattgcccaagctggtctcaaactcctgggttcaagccgttctcccaccttggcctccttaagtgctaggattacaggtatgagccaccacacccggccagatcctcttttaatgataagtgagaaaatcttcccacttatgtttgatttctactttatcactaaacaaatgtattacgtatgctaaaactcacactacagattataaaccatatacttgtttactataatggaatcttaatgtgtaagtatctaatcaattccctagacccccaacaccaccaccttgtacacaacctggatgtttattttagttagagcaaaggaagagcttaatttcagttccttcataattgagaatgattgaaattcatcagataatacgcctaaggagaacatttttactatattttgggtgctttgatactgtcttcctattgattatctcgcattagcttcaattttctacagggtctgcctgcctgtggttttgatgaaaacaaccccacaggaataatagcagtgagttttagtctgttgctcagactcatattttaaaagtctctgctgtgcacagggtaattaaaaataaaaaggctgtaagagatcagtcttccatgcaaacccatcactacatcaaggagaaaagtgtcatctcaggccgtctgaatgtgtcaagagcatcatttctggacttagggaacagcatttaatctatcattgttgctttaatgttacttttaaaatgctcgaaactggggattgtcagcctacggatgtttagacatcatcccttcttgaagcaaacaagtatgtggtcttaatagagatcaatagttgtgggtgtgctttgcaggacaagatgtattgatgtagaaatgacttttttaaaaaaactctatgtaggatttgatgaagatgaggtatttgttggagaatgtctggacccatgtctaaaagcatggagatatgtaattactatacattatttaatataatgcactcaacatctattatttctcttcttgagaagacttcattatcctttgatcatcttatgaccatcctttagaataaaagctacaagttttattccaggacagacccttatgggaacgttctgatcgcatgcaacactaaggcattgcttcatattcttcttgacaactctgtgtgtttttttttaattctagcatttaatcggagtctatcctatacatgctactcaatactttttgtaaaattaaataatacagttagaatagaggtctctgtgtgtttttgaacttttctcctatgcttttgtacagaactacagtgctgattttaattctccaactccctttttgtttggttgggttttttcatgctttttgttttatttatttgtttatttatttatttatttttgagacagggtctcactctgtcacccaggctggagcacaatggcaatatctcagcttgctgcaacctcaagttcctgggctcaagcaatcctcccacctcagcctcctgagtagctgggactataaacatgtgccaccatgcccattttgttgttgttgtttttaatctttggtagagagaaggtctcactatgttgcccaggctgatcttgaactcctgggctcaagccaccctcctgccttggcatcccaaagtgttggatgacaggcgtgagccactgtgcccagccctaattttccaactctatctaaccctagagagctgagtctccatagttgggtaaatcagttttctttgaagatgtgcttttaaccttctttatcccaagtgatatcacgtcctatgacatcctatgaggggtctatcagaacgttttccacatagtacagaatcatagtctctaaaacaatccctgcatctctctgactttgtatacccttccagaaagaatatttattggtgataatgggaatctgtttttgaaactactgtaggcctagtgtgtttagattaactgttattgaattgcatcctgtatttattgatacaaaaaacaagtgcttggcaagaacatgtagaaaggccatttcccactgaagaagactgtcatgttgagataggaatgtattggatatttaagaatagacttttttaaaaagcaaatagaaagaatggacatttaagaatagttaaaaagaggataagacaatgagatcacccatgaaggcaggcattatttcatagatcataaggtttcataggaggaaatataaatttgtaaaacggaagagattcactgagattaaactatgagttatctccatagtcaaaaaatgaaatttgtgttttcagagaaataaagatggtcctatatatgttttaggaaacaattgtcagtcaacagaagtttcaaagaagtagagatagccaggatactgaatatatttgtgtaggggagaaattgaaatatttgctgccataaaatgtagagtcactagaaaaaaaaatagggaggaaatttcctaaatcatgcatttttatcattgtcactgagaagaatgaggccactttaattcctaggagagttgaccacttcttcaaagaaccttttgcttaacttttttttttttttttttttttttttttttttgagactgagtcttgctctgtctccaaggctggagtgcagtggtgcaatctcagctcactgcaaactccacctgccaggttcaagtgattctcctgcctcagcctctccagtatctgggactacaggtttgcatagaaatgggttcttgtcatgtcggccccaggctggtcttggactcctgacctcatgtgatccacccaccttagcatcccaaagtgctagaattacaggtgtgaaccaccatgcccggccaagtttaacatattttaagaggctgctttgtgttcaaagagctcttagcggaggtttctgagaagtcaatgaaatcaaggatgttcatggagtgctgcaagataaatgactgtagtttggttgtagaggagggctggggcatgaaaagaagctggagacagagagagagagagagaggaagaagaagaagaagaggaaggatagagagaaaagaggaggacaggagaggagagagcctggggccaaatccatggacaacaggagtagtgtttgggaaacactggctgcgggaggcactttgtgcagcaaaggtaattgattattgatggagttagagggatagatatttctaacagtatcaacatttactttagccaggtgcagtggcttgtacttgtaatctcagtattttgggaggctggaataggaggatcacttgaggcctggagtttcagatcagcctgggcaacatagcaagaccccatccctacaaaacattaaaaaataataataaataaataaatttgggccaggtactatggctcatgcctgtaataccagcactttgagaggctgagttaggaggatcacttgaggccaggagatcgagatcagcctgggcaacatagtgagaccctgtgtctaaaaaaaaaaaaaaaatgtatttattggtttcattgcattttgatgtcacaaccccaccccatgcagacattcagtagaatgtacacaaggaagtgcattgtatacagtgtaggagtttcctagagctgtcttagtacaaaaacttgggcaccctaaaaccaaagaaatgtattctctcccagttctggagaccagaagtctgagatcaaggtgtggacaggactgtgctccctctggaggctctggaggaggctccttacttcctcttccagctcctgggggctccaggcgtccctgagctagtggccacatgactccagtccctgcctccatctccacgtggccttctctgtgtctgtgtctcctcttctgtctcttagaaggacacatgtcactggatgtagggcccattctaatccactatgacctcgtttcagtaattacatctgcaaaaacccttattccaaacagggccacattcacagattcttggggttagatttggatatatcttttgaagtgccatgattgaacccactcaagcccttggggaaactcagtagaaggtcggatgtttcagaggtgagcagttggtgtaagaatgagaaggagaccaacccaagacaatgtgatcccttccatggattgaaggttgggtgtaagtgtggagagaacatgtggatttacctgtcatttggacagaggacagagcataatgataccaatagatttctcaggaacttcagataacatcatggttatactgttatgtgagtgatatgatctggctgtgtccccatccaaatttcatcgtgaattatagctcccacaatttcctcatgtcatgggagggacctggtgggaggtaattgaatcatgggggcaggtctttcccgtgctgttctcgtggtagtgaatgagtctcatgagatctgatgggtttataaaggggagttcccctgcacaagctctatcttgcctgctgccatgtaagatgtcccttgctcgtctaccatgattgtgaggcctccccagccatgtggaactgtgagtccattaaacctattccctttataaattgcccagtctagtgtatgtcttcattagcagcatgagagcagactaatacagtgagtttcaagtttctgtaccttttacttttatttacaaagcgtggattttggcgtgaaattctgctttgcagaatgtgttatttacaaactaatgtttttagagggacttccgagtactaaagaaaaaaaaattaatgatgaccttacgaagtgaagcaggtatgaaaaatagtaagagatgaaaacatacaatggtgaagaggatatatttgaggttaggaagcctgttagaaaaaaaaaaagaacatgtagggaatggggtaattagtcatacctactcaggttggcttctgaatttctacattgtgtttctccctggccagtatccttcggtgctctttaattaatgttaaattgtacccaaaagaatgtggttaagcaagctcaaagaacctcctgcagatgctgggaacgtcattggctggcctccatgtatctgcaaagagatcagctggtgaatgaaaacgctcactaccctagaatcctggcactttgagaggccaaggtgagcaaatcacttgagcccaggagttcaagaccaacctgggcaacataacaagaccccgtctctacaaaaaacataaaaagtagccagggatggaggtgcatgcctttagtcccagcttctcagggggctgaggcaggaggatcacttaagcccggaggcagtagctgcagtgaactgagatcatgccactgcactctagcctaggtggcagagcaagactgtgaaaagaaaagaaaagaaaaaatgctcactgtcctggctcaaagttctaaaaggtgataaaataaaaagcattcctttacaaaaaaaaataaagcaaatttatccatttttgaataagttaaagaagaatagtgttttataagacaaaaagtgcttccagctacagtaggataacctactgactttcttgctgtgatccatattaatagatggagatgttgtcacagatggagatgatgtctctgtctccacctcagaacgtttcttgagcctccttcaccataacctgcttattctgtggttccctgcatgttgacgcaggcagactgccaaaggtttattgatcattcactttcaacaagccacatgggaagactgcacatcttgcagatattttgtggtcaccgccgtgggatttagtgcttcttgagaggaaaaagctttggggaaatcgatccttcagcagcagaggatgcttgtcacttccgaaccaccctcagcccctgatgccctcataggagaattaatttggcaacatcttcacttgggacgccatatctgtcattcatatccaacatgattgttgtttcatttattcattcattcattttagctatctgatagagactatttctttcttttctctttttcttaaagctttatctatcatttatttatctatcatctatgttccatctagctgctattatctatcaatcatctatgacctatttatccatctatctgtgtagctatttgtctatcatctatcaatcacctatcatctattttctatcatctatatatctatttataatctatcttctatctatcatctatttatatattcattatctatcttctatttatcatttatcatctatcaatcatctagctatttatgatctatgtatgtgtttatccataatctacctatttattacctatgcatcaattatattctatctatatgtctatctgtctattatccattatgtatctatcaatcatctatcgatcatctattcattaatcatctatccatctattttctaacttctatctattaatcttctatcatccacctatatatgaactgtctaacttctatctatatgtgaattatctatttatcatctatcatctacttatctatcggtgaattatccatttatccatcatctgtcaattcaatgtattcatctctatatctacttcaccttttctctcttactgagttacatgggaccatactttcttccttccgatcttccactttcttgcttcctctttccctaccccaggcccctgttccctaatataaagatgtttattaagccaataattgtccacatttctcaaattaataatcaaggtatattttttataatgtgtagagatgaagaaagaaaagagacaataaaacgaggataaagtaaaaaagagaaataagtgttagggaggtggggaagaaaaagaagagaaacatacaacctttgaacctcggtgggattttttcttttcttgttattttgttatttatttgcttaactatcagtctccatgattatttgtatcttatatgaacctccaggactagcaagggtgacttctggcattttccctgtgctttatgaaataggacatataaaagaagcttgaaccattttttttttcaaaaaatgtagatcttgtagattttaatttttcaagttttcttttttaactttaaaaaaatataattttaactgctattttagatggagagggtgcatgtgcagatttgttgcatggatatatggtatgatgctgaggtttgtgatatgaatgatactgtcaaacaggtagtgagcataccaataggtagttttgcagcccttgcccctctccctctctctgcactctagtagtccccagtgtctattattcccatctttatgttcatgtgtacccaatatttagctcccacctataagtgagaacatgtggtatttgattttctgttcctgcattaattcgcttaggatcatggcctctagctgcatctatattgctgcaaaggacaggatttcattcttttttatggtagtattccatgtcgaaccacaactttcaatgcaaattggagatgtttgtaaacctggaaatacaacgtatggtaaggtgaggtggcattttaatgatttatgcttatttttgctccaagtatggtttgttatcttacatccataaccccaataaccctgatgactttctttctccccaaattccatgcatcctattgtatgcacataatggtttagaccaacacacacttttttttctttagctcagagttctgtaggttggaaatccagttgcatgtggctggattctttgttcacagtcttgccctcaataagcctgggttgggctcttaactgcaggctctcagaagagtgttcctttgggttgttggcagaattcagttttgtatggttgtagaacattcttcttttccttagcagctatcagccaaggaatgcttatggaaaccaattacattccttggcatggggtcccttcaaagccaaagatagcagatcagatccttctcaacctgtggatttctctgacttgctcatctgccagcagctagagaaacactctgcttttttaggcctcgtgtgattagatcatgcccaccaggataatatctttatcttcattaattttcatttaaacatgtcttacatctgaaatgtactcatatagcatgaattgtgggtatgggctgacttacttctaagtgggcaatgaacattttttgttttggtaaatattttaggctttgcagaccacatgggctctctcattacagtgacaaagaaggcacagcaagcacacacacaagtggtcatgttccaataaaactttacttacaaaaacacatggagggccagatttagcccttcagctgcactttgctgcccattgttctagatggagaggtacattagccaagcctatctatcaaattggctgtccttttaccagtccatcaaaaggctacatttttcatatgtgttaaataaattcatatgtatttataacctctgcagcccatcatatttggtaaattttccactgtgttccaaccctattgctgaaaataactagaaaatctggccatgatatataaagaatactcagtgttaagggagcagagagctagtagaagattggtcctgagagatcagcataatagaaaaaaaggaaacagatgagagaagcattgattctgagttatatggtccatctgtaaacagatttgcacctgtctattaagataggaagaagcccagtcacagtggctcacagctgtaatcacagcactttgggacgctgaggtaggaggatcgcttgagcccaggagttggagaccagtttgggcagcatagcaaggcctcatctcaaaaaataattaaattttttttttcctaaaataaaatagaataaataacatagtgagaagatgaacagaaaacaccatcaagcagtataatttttctgaagtaaaattataaggtagaaggggaaaaaaactggagatcaaagtccatgaatgtggacaacatgataacaccatgtggataacatgagactcttggtaaaggctggatgttaagagtaggggaaagttagcaatagaaaagctttcagaaatgctgcagtaccagtacaggcactaagtggctccattcctatttgaattcaggaaatattctctcaccctaactgcttgacagaaaaataagtcctttctggaagaataagatatacaaaaaagaaatttaaaaaaacataaaagaatattatataaaatgtccagaattcactcaaagttatcaagtatattaataaaataaaaggcaaggaaaagtaaaacttacaggcaatataaatagctctatgtgatatcaaaatattgattgttaaattcaacttttaaataactatgattaatatataaagaaattagaagaccagatgaaacattctggtaggtaactaaacaattttaaaaagaatcaagtgaaagttctacagctgaaaaactcccgatctgaagtaggaaactaaataggcttaacagcagtgtagattctgttgaagaaatggttagtgacttggaagactgattgaaagaaaatacccagaaagaaagatggcaagtgaaaacaaagggtggaaaatacagaagaaagagcctaagaaacttatgaaactgggtaaacactgccaaaatgcatgtaattggagagtatttgaaggggaaatagaagacagtcaatgacaaacagttaacagaagttgccaaaggattttacaaaactgacaaaagcatcaaatagagaattaagcagaactacaaagcccgaacaagaaacaaagtaaacatcacaacacatatcagaatgacaaaccaaagacatagaaaaacatctcaaggcagccattggtgaggaaaagcacatgactttcatagaaggaacaagacaggtagaaataatgaaatgctggaaaaaaaaaaaaaagaacttcatcaaagtgtcacaaaaatacggtgccatcctagaaattaatggccaatgaatatgcctttgggaacattagccaaatatatacattttccaaaacaatgaaacttacaaatttatcagcagaccagatctaagggaaatactcaatttttaaaaaccaatggaaagtagtgccagattgaggcccagaaatggttgaaaatttcagcacagttgaatgcatgagcaatatgggttttataaaaccatattaataacgtcttacttatgtatatgtgtgtaaaggaagttaaaacagtaaaagaagatgagagataataaattatcatacagtatccttgtaagttaattgcattttctggaaagtgatgtggtaaacatgctaatttttgttagacttgtagaaggcattgtttctttgtgtatcttccagagtaactacaaaaagtagtgtgaataaaatttaaaagaagtaaaaatgatttaataaatacaaaaatgcataataattatttaatttcttcacaaaatgtaaatgtgcctttatatcataaatacaagttgtccaaagagtacaattaaagggaattctcatactgagtaaaaataaaatccaaagatatgctgcttccatgacacaaacacaaagcacaaaaatagacaaagattaaaattataagtacagaaaaatgtatattaactaaaaactaaccattaaaaaatatatgtagtaatactagtatcagtcaaagtaaaacacaaggcaaaccaattactaaaattaaggagggctatttcaaatttaacaggaagccataaagttataaatccattggtgactcagaagagaggttcaaactctgtaaatcaaaatgtcacatatcatagatgagaaatagacacattcatgatggtcaactattttaatacatcgatcacagtgcctgattgaacaagaaggcacataattagaaatgataaggaagaattggaaacacaagtgacttaattggcatatgtagggcaatgcagccagtgaccacatagttcttatttgtgtcaaatgcccaagggacgtgcatcaacattgaccatatgctgcactgtaaaacaaatgttgacacattttataggaatgaaaatatcaaagcgatgtgctctcatcacaatggaattagcagcaattcaagggcacaaatacaactagaaaaacccaaatgtttgtaaattaaacgacacataatcaactcaggagttaaagaagatacacacgggtgattagaaaatattttaaatttaatgataattaaaatgtgacatatgaaaccctgtgaatacatccatatttaggcttggaaagataaatgcagctgtctcagtttgtttgggctgttgtaacaaagcactataaactgagtggcttataataaatgactgaaatttataactcatattgctggaccctgggaagttcaagatcaagataccagcagattcagtgcctggtgaggattcacttcctaacttatacaaggcaccttctcgctgtgtcctcacatattggaagaggcaagggagctctctttggtttcttttatgagggcactaattcccttcattagggctccacccttatgacctagtcaccttccaaaggccccacctcctaatgctgtcatattgagtattaggttctaacatgaattttagggggataccaatgttcagaccatagcaacagccttcgttgcctataatggttaattaatgctgaatatttattactataaatcactgttgataaataagaattaattaatgcagaaaattgatgctgtaagtatctgagccatctagaaaaaaattcaacctcttgaacgcaagatattagaagaaggtaaattaaagtaagagaaaatattaataaaataaaaaaaaagaaatcacttccaaaattgtgaaaacctctgaaaatcctcccctccttaaaagcaaagagagcacttggaaatgttgtcaaaataagaatgttcagaatgctaataattaaccaaaagctttcaacagtcagaggcggattgatttaagaaggatagttgaattttggtaagggcagaaggctttgtggtgttttaacatggtctattctccttgtcttctccccaatttcatggtagccttgtactccagccttgaaggccgtatagctgtgaaaactaacagcctaatagccactgagaggggacagaacgagaatggagctcctcaaaaagctccatgtagagaaaactttgtgcatttgacctggtagctccccggaaaagctccatttatggaatttgtttttatttgacttgacaaagaggttgcacagtgggaaaagatgtttccccactttgcctagcaacagcagcatacacattcttctcaagtgcccatgcaacttattcttaggcagaccatgggttaggtcatacaacaagactaagtgaagttaagggaattgaaattgtacaaagtatgtctctgaccctagaggaaataaattataaattaagagcagagagaaatttggaaaatttgcaaatacgtggaaattaaacagcacactcataaataaccaatgggtcaaatatggaattaggaaagcctttagacaatgatgtgagaccaatgaaaagcatggcataccaaaatgaacaggattttatacattatatagaggtaaagtagtgcttaaaggtcaatttatagctgtaaatgtctacatgtaaaattaagaatatctcaaagcagttctctaaccattcacctttagatcatagattaagaacagaaaattaaaccaaacatgagcaggagggaagaaataattaatattggattggaaataaataaaatagagaacagaaaaacagtaaagaaacttaatgaaatcaaaggtcgattatttgaaaagataaacaaaattggcaattctttagttacgttgaccagaaaaatgatttaagtagttgacatcagaaataaaagagggacattactactgaccttacggaaattttaaaaatgagtataatacaatgaataatcataaaatatatatgaggcaatctaggtgaaatggatggattcctaaaaaagacagaaactactgggactaatttaaaacaacagaaaatctgaataggcctatgaactaaagggagtgaaatagtgattaaaaacaaagaaaaaaacaaaactgcaaaatttccttcaaagaaaagcccaagaccagatgacgctgtcaatgaaaatgaataccataacttcatgaacgcttttgaaaatgagcacaggagaaaacttttccaaagtcatcctatgagggcaggatagtcctgataacaaagccaggcaaagctatcacaaggaaacaaaattacaatcaatatgccttatgaacatatgtacaacaatcatcaataatattttagcaaaccaaattcagtaccatataaaaaggactttgcaccatgaccaaatgacacagagatatattttggtaaaatttcattgatatggagtacattttagaagtctccacaagggaacagcatttcctgaatatgaaaggaaatcatcttaggaatgtggatgaacatcactccattcctgaatgcaatgagataagtctgcaaactgagggtggatttctgtacccatccatgaaacactcacctagcagagctgacagtccggtttcacacttgccaggatgcagtttccatatgacatttattttcctcatgtgaatattaagtgagtatcgcaatgcagaaactgactagccaaatatacattgcgtggtacctgagatcttaacagagagtgaggtaagaaaatagtaagaatacacatagactcacaacacattttatacagcttggattgataatatgtgctaaataagaaaccattatggcatatgtatattcataaggagaaaacgattagaagcttgggagaatacattttaaagtatttcagcaaaacctgggttttcatcagagtatggatatgggcatttaaaagcattattaatgcaaaatcccaagtaaggagtagagaaaatgtgactcgttgattgaaatgtcctgcaaaaggaacatagttgacatttcattagataaggtgatggattcatatagtttatagagaagtgtttgagttgagaattaaaccatgaactcaatttaaaagtgttgcagaaaatggcttttagtcataaatacaatcatcccccacacataaccagagaactgcaaacattagctacaaatatgcatttttcaactattagcaaagattacaaagtttcataatatgttggtgaaagcttggggagctaaagaaaaaaagtcttccagatattttggactatggtgtccattgatttgacttctttaagggactttttttttttttttggtgcaatatttgcaaagttaaaaacgtatcattgttccttccattgtgattgttggaattcatcttaacacattctcaaatgtgccccaaaatattaatgtaaaataatgcagcattatttgaagtagaaatatattataatgagtcaaatttctgtatgatttaaacaaattgtaccacatcaatattgtagaagaaaatgcagaccctataaaaataaaggtgatctatatttaataatttaaaaagatttaatagaggtataagtataggcatctctagaacaaaattaaaatatattgcatagagtatgctatgataatatatgagtagaccaaataacaaaggaaggacgtgtttcaagtgactacttaagaggggaaaatgggagctcaaatataggaacagcacttactttcaattgtgtattattgtatgttttttaacttggcacatgaactttatgcatgtatataatatatattttatatatataatataaatgtgatgtgtttatattttgtatataatatcaatgtgatatgtttatattaatttatatattatatatatttataaatatatctgtccaatttccaaattagagtgggaattagatcaagattaaagtgtgatttgaaatttggtcaagctacaaaaaatgtaaatataaatgtaaataaagaagaaacaatggcccagcataaaaacaatgtgcatagagtaagataaaagatgaaaacgatcaggtactgtattaaatatgttatctcaataaatatggagaaaatcaattttcctatcaaactaaagactatcagataaggttatgcagataaaatcaggttgggcatagtggctcatggctgtaatcccagcactttgggaggctaagatggaaggatcgcttgagtccaggagtttgagaccagcctgagcaacagggtgagatcctatctttcccaggaaaaaaaaaaaaaacaattagctaggcatggaggtacgcacttgtgagccctgttacttgggaggctgaggtgagaggattgcctaaacccaggaggtcaagcctccagtaagccatgatcgtgccactgcactccagcctgggtgacagagtgaaaccctgtctcaaaaataaataaataaataaataaagataaaatgtatttgcaatgcttttgaaatgatacacagtaaagcaattaaaaaggaaaacaataaactaagacacaagaaaatacccacatggaaatgtaaattttaagaaaaggattgattggtcgtgttcacagcagatggagcagaattgaggttcttcattgagatttggaagataaatgctgggacccccagccttgaataaacacagatgggtgcatgcaataaaaaagcctctgctcttttctggctttgaacattgtatgtatattatgtgatactcagagccactgcagccactttgaggacaaaacaattgcaataagaaaaagaagagttaaaaaaaaaaaaggcaaagaaagaaactgattaagacccctggaattgttgagttgctgaattaacaggtcctggaagtgttttctggcctctttctttttacctgagaaatataaacccttattgttcaagctacttttatttagttatgtttttaattattaaatttgaaagcatcctaagtgctatattgtgttttgggaaaaaaaggtataaggtataaatcataaatatatctatattatatatacagatatatatgatacatatctatgtatctatatgtcatatatatgatatgtatttatctatatatcacatatatcatatgtatatgatatatgtttgtgtacgaagccacatatcaaattaatgaaaccaaaatcgcattgaaatttgaggagaaaatgatagaaacacctttttggaggttctgctagtataataagacaaggcattggaataattagaagagtaagaaaaaatatgtttattcttatctaataaacattagtaagtgagtgtggctaatacataggttttccaacatggttggatacaagggatgtgtataaaaggtcacttttcagttattttgaaaatagtatatgataactagaaatgcaatcgtaaattaaaatggtatcacacatattattaaacctgtagacatatttaccgagaaaagagtaacacaaatcttactgaaagtcaaatcttaggctgggcgtggtggcttgcatgtgtattctctgaactttgggaggctgaggagggaagatcacttgagcccaggagtttgagaccaacctggggaacatggaaaaagcaggtctctacaaaaataaaaatattagctaggtgtggtggcttgtgcctgtggtcccagctccttgggagtctgaggtgagaggatcacttgagcctgggaggtggaagctgcagtgaaccaagatgatgccactgtacaccagcccgaatgattgaatgagaccctgacttgcaaaaaagaaagaagtaaaatttgtagaatatgtaaatttatgtattttttgaaaaaactttttatctgacttgaaggaaatggaatggttcaacaaaatggcatcttcacaacattttattcggccattaaatcaaagaaaaagatttacatactcaacaacttgggtgaatgccatgtgtgttaagtcaataaaagcccattcaaaagatcttatactgtattactccacttatagtgacaaaattctagaaataattgtaataattagcattgccaagggttgtggatagtggagaggaggttgtattaatctgttctcacgccactaataaagacatacccaagactgggtaatttataaagcaaaagaggtttaatggactcacagttccacatggctgggaagacctcacaatcatggcagaaggcaaaaagaggagcaaaggcacctcttacatggtggcaggcaagagatcgtgtgcagggaaactgccctttataaaccagcagatctcatgagacttatttactataaccagaacagcacaggaaaaacccacccccatgattcaattacctcccactaggtccctcccacaccatgtgcagattatgggagctacaattcaagatgagatttaggtagggacatagccaaaccatgtcagaggtgaaccagtttcattagaaaaagggatttttatggtaatgaaatagttctgtatcttttcagtggtggttcctcaaaagtagacatgagaaaaattatgtcataaaactatatatacattggacccatattaatttctttgacattgtagtataggtaaataaggtattgccattaggaaaacctggttgaagggtatacaagacctctgtgctatcttcacaaattcctatgaatctctaattctaccaaaattagttttaaaaatacggtatcagtgaatgtcaggtttaaactgtctttacagagattaaacttaataccttaaatggtatgctttcatgtcacttctgattctttttctgaatagtttaaacctaatggtatgcggtcttactttagaagtgaatatttccgtgttttatatttcacatatttgcttactttctcctttgggtattttcaaatgcttacaataatttgacaccatgattcactgtttactcttgcttgagaaataaaattccagattggaaataactcacaaacgcattaacagtattgtttattatcacctgcaatgcctaagcaaactttcaagatctcacgattttctttctctctcagttcaatcagcttttgatttgctatttcgtttcctgttcttcagattaactttctttttattcttcccattaaatgcaatttttcatctttttacgtttgttctgccttcaataacagagaaatattatgtaactgtgtttgcccaaactatttttttctagttgtttccctgacttaatagctcagtatgactcagcattctagaaattaaaatagaggaagattctaaatacacaatcaacttcgcttttgtgtgttcatcacagcaacatgtaacaaaaagaaacatttctttagagtagaaacattttgagaatctagctttatttttctttttttgagacagggtctcactctgtcacccaggcttgagtgcagaagtgcaatcacagcacactgcagccttaacctactgggctcaagcaatcctcccacttcagcctttggagtagctggaaccacagatgtgtgccaccacgtctggctaatattttttttcttttatattttgtagagactgagtctcgctatgttgtctgggctggtctcagactcctgggcttgagccatcctcccacctcagcctcccaaagtgccaggattacggacatgagccacctcacccagccaggatctagctttcttgcacctcttagaagtggcataaatgtaatggaaacagagccttattagattttcatttaatgttttagaagaaacatcagtaaaaagctctctaaaacatctccttttgtagataacgttaaaaaaacccttcaaaacataaaataaaaatacttgagacttcattgttgatgaattattgtatgcatttaagcactgcaataaaattcagtttagaacactaataaccctagtcagaatttaattgggaggctaacaaaaacctagattattgttgctcttcaaaatatgtgagctcaaagatggtacttttgttacaatttaaatgcactatggcttctatatttttaagagcagaaaaataaaggagcaaacatttttacatatacaaaataaaagagtgaatcacaagctgataaattttgcttctccaaaagaaacatgtattcatagaaagtagagacttattctaatatttataaatgcaatattaagcaattctttacaaagcaggcataatacacaaaaacaaatcatactgctaggctaaatgtgtagctttcttacatttattaagaaaacacattgtcaagccatcttttggcattatattaaagtgcatttttgcatagtttgtgtggcaaaatagtgaaggttttcagaaggatatgtgtgtggaaccaacagataaacatatatgtgttcaatttttctgttaaaaatagcattgcatctccaacacaataaagaataacaatttgctccctccttcaatctactctcagtgggctacagatgccaggtcaccagacattgttcattctcttaaccaagggggagaatcctctaacctggggctccccaacccccaggccacagactggtactgtggcctgggggttggggagccccaggttagagataccagtccgtggcatgttaggaaccaggccacatggccgaaggtgagtggcgagtgagcaaacaaaacttcatctgtatttacagctgctccccatggctcacattaccacctgagctccacctcctggcagatcagtggcagcagtagattatcataagagtgcaaactctattgtgaactgcgcatgtgagggatctaggttgcgtgctccttatgagaatctaattcctgatgatctatcactgtctcccatcacccccagataggactgtctgactgcaggaaaacatgctcaaagatcccactgattttacattatgatgagctgtagaataatttcattatatattacaatgtaataatggtggaaataaagtgcacaatatatgtaatgctcttgaatcatcctgaaaccatccccctgccactggttgatggaaaaattgtcttccctgaaactggtccctggtaccaaaaaggtttgggactgctgctctaaccctcttgtctctagggagaggcctgtcctaatggttgcttggacctaaagccatttaggacaaggagtacttgaacgaagctttcctccaattgccctagtgagattcaatacaaaatttgaggagcccagaagtacaaagtggagtccagttcactgcaaaagaggcaggctctcaaaaaatttttcctttcctctctgagttagtgtgctattgctccctagtacttaaaagactgtaaaccaaaaataaaatcctaagctcctcaactaactgaacaaaccccctctgggccaaagggaccccagagaaacctgaaaaactggattcccagccatgacaggaagagaggtcagacatacgtccttccttacccctcctgccttttggagtctaggcacaacccaccagcattcacattaaagtacggctcaaaagactgacaaaacagacccctgggacaggaaattaccaaattccaacctgactctggtatagcatcgtatgacagatagcagacccggaaggaaatcaaaatatctcaccccaacatagatttctttgtcatattttgaaatggccctgcaaaaccatctttcctggcagaaatttgcatctgtggagaatctccattcatacagccaggactttgctgtatctaggaaagattaactctaagtctgacaccttgaaaggtctgaaaagagacatttaccatctgttctctctgaaggctgctacctggaggtgtcttctacatgataagtaccttggcttccacaactcctcgccctttatcttagcatttatttctactgacttcaactctttagacaaaacttaactctttcaaccaattgccaatcagaaatctttaaatctacctatgacctgtaaggccccacttcaagagatcctgcctctttaggctgaaccaatgtacactttccatgtagtgattaatgatgtcacctacatttcctgtcaccctaaaatgtataaaaccaaactgtaactgcctcgggcacactttctcaggacctcctaagactgtttccccaggccgtggtcactcatattggctcagaataaacttttaaaatatttgacagagtttggtttttccattatcaaagctaagaggaagtggataggtagcttgatttatctttgctttaaacctggaagtgtaggctgggcacggtggctcatgcctgtaattgcagcactttggaaggccgaggtgggcaggcagatcacttaacgtcaggagattgggaccagcctgaccaacaaggcaaaaccccatctctacttaaaatacaaaaattagtcaagcgtagtggtgcgcacctgtaatcccagctatttggaaggctgaggcaggagaatcacttgaaccccggaggcagaggttgcagtgagccgagattgtgccactgcactccagcctgggtaacagagcagactccatctcaaaaaagcaaaacaaaaaaacaacctggacgtgtgaatacacttgggaatagagagacttgaccaggtatacctgtgacacggactttctggctgtttgaaccctgtaggttcacaggcatggacgccaccgcacattctgctttgtggagggcagcagtgtaggtactccagcaacaaaggggtctaggataagggatcccccaaatacaagggggccagcagctggagcaagaaatgcagcagagcctgcagaagtccagaaaacagatgctcagaccttgaagtcaatttgaataacaaaacaggacctaggacttaaggagatccagataaaaaatgcaactctctccttaacatcaatctactgaaacagagattctaagatgcggaaacagtggtgacttgaaataggagaaagaatatcattacatgctaattatgttaaatatgagatataatgagaagaatagaaaaatgactcattaattattaatgaactgaattacctcatccatattacaaaaactaagctgcatcctatttatgcaagcatactaaaaaataaagtgataaaaaagtttcagaaaacaatgctatgtagcagaggcaataagaatttgtcaagaagagatctagtgttaaaaaaatgtaatgagagtaattttatttacattaagtaaaaataacagctaaatgagtgaaacaaaaatcattaggagtgaaaggggaaatttttaagattatatttatagaggcatagtttgcatgcctctactacttcatgaatttgagaaattagtaaatctaacagtgaaaaataaggaaagagaaaaacataagaattcaaatgataggttcaatttaatatgcctctcatttatgcatatatacacacaggcatatacatgcatatatatatgtcataatatctttatgtacatataatggccatatgcattattgagaacatacacatatacagtatcaatataatttgcatataagaaacttcaacaaatctgaaaaagtgaaaattgtgtgtgctgtatgctgaaatcataacctaaataagatataaataagcacagataattgaccctaaacttccacattgtttacaaattaaggaatgtaatctaactctgtattcaaagaaggtatcaaatctgaacctataaaatatctgagagtaactataatgacaacattacatcaacagcgtagccttcagcagtaagagtgtaactgctctacgggttcttcctgccctctgcacaaagtaaatccatggcattgcggtaaagaaagagtttaattggtgcaaggccagccatgccacataggagacagagtttttactcaaactagcctccctgaagatttggagactagggatttttaaggataattttgcaagcagagggccacagagtggggagtgctgattggttgggttgaagatgaagtcatagggagttgaagctgtgcttttgcgctgtgtcagttcctgcgtgggggccacaagaccagttgagccagtttactgggtggtggcagctgattcatcgagtgcagcatctgaaaaatatctcaagcatcaatcttaggttttacgatagtgatgttatccttaggagtaactgggaaggtttagaatattgtggcctctggcttcatgagtcctaaaacataatttctaattttgggcttcatttcttcatcctacaaaggcagtctggtccccaggcaagaaggtggtttgtttcaggaaagggctattatctttgtcaaagttaaactatgaacaaaattcctcccaaagttagttcagatgtccaggaatgaacaaagaccgcttggagtttaagagcaacatggagtcagttagggcagatgccttttcactgtcataattttctcactgttataatttttgcaaaagcagttttaggaacactttaaggaaaacacagcctcaaatgcctttattatctaagagaaatgagagacgaaaaggaactcaatatttgtttgaataaattaaagaacaaaacaacatgaaattaaatagaaaaatgctaataaagcttaaagctgaaattaatgaaatgggaaataaaaattgtacctatcacccaagataatttcttaaaattatacaatgaaataaaatagataaagcttctgtgagtccgatggattgcaaggaaacaaatagcaagattatgttataaaaaaggggcttaaaacaaacacagaggaatttaaagaaatagatattaacaataaaaaactacatgaaaatctacgacatttaatttgaaaacatagaagaagcagatgattttgtgggaaagaaaaattaccaaatttgatggaagaaaattgagaaacctaaattagctggttttcatggaagtaaatgtcaagcccattaaagatctactattgaaatatgcagcaggaataggtggtttcacagctgaattgcagctcatattgaaatttaaaaaaaccataatcttgatgttaaactctttcattccacagaaaatgatacagagcccactaatttatttgatgaggatgttaccagaaaggggtcctgaaccagaccccaagagagggtttttgtacctcgcaaaagaaagaactcagggtaagtccatagagtaaagtgaaagcaagtttattaagaaagtaaaggaataaagaatggctattccataggcagagcagtggcttgggctgctgactgagtataattttagttatttcttgattgtaggctaaacaaggggtggattattcatgagttttctgggaaaggggtgggcagttcctggaactgaggtttcctcccctttatagaccatagagggtaatttctggacactgccatggcatttgaaaactgtcacggcactggagggagtgtcttttagctgctaatgcattataattagcatatgagcagtgaggacgaccagaggtcacttttgtcaccatcttggatttggccagttttggtcagcttctttatcacatcctgttttatcagcaaggtctttgtgacctgtgataccagttctgccaacctctctcatactatgacttagaatgcttaccctacaagaaatgcagtccagcacgtctcagccttattttacccagcccctattcaagatggagttgctctggttcaaatgcctctgacaaggacagtatagaaatatgacaaacacaaggtgtaggtcccagctagctttgcacctatcagcatgaattttagcatcttcattggttaacaagaatgtgcacacaaggtgttctggttcagagacagattttttttattaaaaaccacacaacaaataagaagtgtgttctcgccctctgccctagtttttaccctggggaaatacaatgagaaccaggtcaattgccttaagcaagcagcctaacacatttcttagattgagagatcagaacaaaacaaatattatctgtttataaaagaaaaggaaggagatatcccttccctgctgaacggatcacctcctttctccagccctttggaatataaaataaaacctctccgggagctgaaggaccctgtgtcttttatcacctagaggtgatgccaagatctgggtgaattccttcttgaaatgtaaatacctacttgggtacttgctccagtctaaaaagtgtctaggggctttaacctaagaacaagtcagagctataagcatttggctttggggagataagaagttttattaccctttccaataagagcaattaactagacatatggctacttatccagttctcacagtatgaggagatgcttcaaagagaaatgaaagcaaacattctcagaaggaatgctaggtcttctcacagaagcacttagacacccagggaggttttaccactccacagaatgagatgtaaacctgccatcctatgactgcttttttgtttgttttagagacagggtcttactctgttgcccaggctggagtgcagtggttcaatcatggactgcagcctttttttttttttttgagatggagtctagctccattgcccaggctgcagtgcagtggcaccatctcagctcactgcaaaccttgcctcctggattcaagcaattctcctgcctcagcctcctgagtagccaggattacagtcacccaccaccacatctgactaatttttgtatttttagtagatacgtggtttcaccatgttggccaggctagtctcgaactcgtggcctcaagagatctgcctgcctcagcctcctaaagtgctgggattacaggtgtgagccactgcaactggcccatggactgtagccttgaccttctgagctcaagcaaacctcctacctcagcctcccaagtagcaggaaccacgggtgtgcaccaccatgcctggctaatatatatatatatatatatatatatatatatatatataatgtagagacaaggttttgttatgttgcctaggctagatgactcttttttggattacgtgagttaacacatgaaataaggtactatctacataaagcatatattcatctttggtactaaaataattattatagcatagacaaatataattcaatcttcctaatgatatcagtacctttaaaatttgtttaaaatccagtagcagagcaaggaataacactccacatggctaagaagagtagccgcaaagatgacaatgctttagaaaaatgcaccgtgttagaaagtgtcagtgtaatccactaattcaaccaatgaaaggcaaaagtgtaattccatcaatagtcatggaaaaattatgaaactgaatctaaaatggtaagaagaaaaggataagacattttaacaaatacgtaaataacagaagcacactagcttggtgcgtggcttgtgctggtaatcccagctctttagcagacccagtttggaggattgcttgagcccaagcgtttgagagcagcctgggaaacatagcaaattcccatctttataaaaaataaacaaaattagctgggtgtggtgacacacgcctgtagtcccagctactcggggaggctgaggtgggaggattgcttgagcccaggatgttgagcctaccgtgagctaggattgcaccactgcactccagcctgggcaacagagcaagagctagtctcaaacgaaacaaaacaaaaagcactcttctaaaatgaataccgattgcagcctaaaaagcaaaatactaaagtaatttcaagaaaaattagagagcacatgagaatgccttttatttctattattatccaacgacttcgggaagattgtggcaaatgcagtgaaatgagtaaatgaaaatttgtgatagctattggaaaagaacagataaaattagagcacttttgctgatagcatgaatgtttacctgagaaaatctaaaaacctattcgaaaaataaggtaatttggtaaaattgctgaatacaaagtaaataaacaaaaattattagtgttttttacatactgcagtaggaacctagaaagcaatatgggagcattctattgaaaatccaataattatgttaaaaaacttaggagtgcatataataagaggggcgctgggaagaaatacattgaattaaactgaaacacggaatacccaaacaaatggaagtacatgttatatcctcaaatgcttaaattatacatcacaaaaatgccaactccaccaaaattgatggatgaatcaattgtcatccaattgccaatcataacaaggtgtttaatcttttgcattgtagaaaatgatctcacagttcatatagaaagatgtattatacaagtatagttaggaaatcaatgagagaaataatacatgatatagggcatttgctaccacatacaggacatgctataatgatactctaatcagatcaatgttattgtcatagcaatatgctataggacgtgacaaaatgtagctgctgcattttatcaaatcaacttctttctttcctgccctgggtgtaggggctggaggctgcttttcaacatcactactgttcagtccactcagtggtctccttttgccttcccctacattttccattttattttaagcaaattgtctaacttgttttcctggctagaccctgacagtattttctaccaattgcagttataactaaagtgaaatacgtgccaatcaaacatgttgatggtgagcatcgtctctatatgaattagttcaattgggttgtataaataaacgaacatgtaaaattatgttttcagttattatatggatagtaatataaagtaagaaattaaggaaaagcggccgggcacagggctcacacctgtaatcctagcactttgggcggccaaggcaggcggatcacttgagttcgagaccagcctggccaaaatggcgaaaccccgtctctataaaaaatacaaaaatttgccaggcatggtggtgcacacctgtaatcccagccactcgggaggctgaggcaggagaatcacttaaacccaggaggtggaggttgcagtgaactgagatggcgccactgcactccagcctggatgacagagtgagactgtgtaaaataaaaaaaaaaaagatattcttctgagtgagggtatacaactgaacaaaagttaaacagctcaaggaggtgaataactgctctgcgttcaagaaaatactgtatgtttttaaaataagccattgatgtctgctttacttgctttttaaaataattgggtagatactctaacaccttgttagactgaaatgggaaaagtcaaattcattttacttttgaaaaatagacaactgataaaatcacagcacctgtgctattttatcaagaaaggggagtgttatacttttctttttcaggaaatacatttcctttttaaattaaatgcaatcgtaaatatatacaacatttcactgctacagttaaagcattagaaagcctcaacatatccacaataggaaagaaagagattgcctatgataataactgtggcttcgcttcataacattgtattaactataaaatggaaaaaatattagtaatactattgagataaacatagtaagaactcaaactcatcagggtgtgtttgatttattattattttgttcctcaaaataagctctatctcctgataaagtaaacactgcatcagtataaatcatatgccattttattttttatttttttatttttattttttgagacagggtgagtctcactctgtcacccaggctggagagcagtggcacaatcacggcttactgctgtctcaacctcctggacccaagcgatccacctacatcagcctcctgagtagctggcaacacaggcatgagccacgatgcccagctaatttattttttatttgtagaaatagggtctccctatgttgcccaggctggtctcaaactcttgggctcaagcaatccttttgcctcggcctaccaacgtgctgggattacaggcctgagccaccacacaagtccccatacaccattttaaatatcaggaaataattaattactttaagaattgtatacagataatattaaattaagcctttagaaaatgtccaggttgggtgcggtggctcacgcctttactcctagcactttgggaggccgaggtgggcagatcacctgaggtcaggagtttgagaccagcctggacaacatggtgaaaccctgcctctactaaaaaaacaaaaattagcctggcgtggtggtgcatgcctgtaatcccagccactcgagaggctgaggcaggagtttcacttgaacccaggaggcagaggttgcagtgagcttagatcttggatcgtgccagtgcactccagcctgagcaacagagcaagactctgtctcagaaaaaaaaaaaaaaagaaaagaaaatgaccaaatgtctaaactctgcatcagtgtaaaggataagtccaaaatataaagtattatttactggaacaaatccatacaatttttcttagcttgtttatagcaaacattgcaccttacaataacacaaacatcaaaacacaatctggaacactttttggaaatatagatatatttaattgtcagagaaaaatgtataaatccaatagggcatgttttatcctgataaaaacctacactctgatttataagaaacataagcatagatagaaacatgaagttattctgccacagatcaaccttttattattcttactttttacctaccagcatatttaaaataaaatagctattacaaaataaaattttctgatattctgttgtttccaagtgttttattttatgctttctcttgcatttcttgtttaaattcaaaactgagcttttgagattctgcgtattccttgattttactttttgggtgtatacaggcaactgtcattgactatactctccagcttcatcctgtctttgttttgttttattttgtcttgtcttgttttgttttgtttttttgagacaggatctggctctgttgcccaggctggagtgcagtggcacgatcttggctcactgtagcctcgacctcctgggcttaagcaatcctcccacctcagcctcccaagtagctgagaccacaggctcatgttaccacacctagttcatttttgtattgtttatagagacagggttttgccatgttgctgggctggtctcacactcctgagctcaagtgatccacctgccttggcctcccaaactgctgggattaaggcgtgagccaccacatctagcctcaccctgtcttttaagacagtcactccaggacctgccagctaatctgttgcctggccatgagcacagctacaaagttgagctagtgactggtagaatactgaatagtctacagttaaaggaggagcgataaatgtattggaagtgcaaaactaaacatatagttgtagggatagaatgcaagtggaggaaaagaatgatgttttttgttagctgaaataagttgatcaatgaatcttcgttgaagaaaggaagagtataaggaaggaaggagagagggaaggaaggaaggaaaggagggaaggaaagaaggaaggaagggagggagggagggaatgaaggaaggaaggaagaaggagaggagggaaggaaggaaggaaaggagggaaggaaggaaggaaggagggaaggaaggaaggagggaaggaaggaagggaaggaaggaagggagggagggaaggaaggaaggaaggagggaaggaaggaagggaaggaaggaagggagggagggaaggaaggaagggagggagggaaggaaggaaggaaggagggaaggaaggaagggagggagggaaggaaggaaggaaggaaagggagggagggaggaaggaaggaaggaaggaaggaaacaaggaggtttattctgagccaatatgaatgacaactgcctgaagaaaacccaaatgcaagaaaccttgagcaaaaattagctgggcatggtggtgcatgcctctggtcccagctactcaggaggctgaggcagggggatcacttgagcctgggaggcagaggctgcacggagccgtgatcatgccactgcactccagcctgggtgacagagtgagaccctgtctcaaaaaataaaataaataaattggcttcttcatcagagttgaagaaaactgagaaggaaagacatataggttcccattaactgtttgtcaatttgttttggaggtgaccttgccgaatactgcacatctctgagggagcctctggccaagggtatgcctagatttatgctagtcagggttctgaattgcagccatctgaagctgactgcagtggattaagcagaaagaggcttaggaaaagatattgcatagataccgaaattgttaggaacggctagagaagcaggctatagggaaatcttccagcaacaatgtctaaaataaagctcatgaactggcctgatggagatgttgtcaattctgcagctggtccacaggccacttggggagtttttgtcatctgcaaagccacaccatgacgcaactctttaagtcaaggctgtgacctgctcccagcatagcctgaccgtggaaacctggaaactccagctgccggcaacacccataaaaatgcctatgattggaggagcctgaatcacaggtttgggtcccaagaggcttcaaatttgaattttctgaattctatcttgagtcgatgagactcataaaacaagaaatatgcaatatgtagcgagtaaaaaacaaatcagggagccaaaaatacaattcctccaccaaagaaatttctgaaggcactgagtaatgtcatgattgattgaacgcatctcctcctgctacaagaaatctagtctgagttatggctggtccgagataaatagataaacagataaacagaaacaagactagaagaacaatccttgtgttggtttgatgtcagtaaatgaaatatgaggacctcattttggaattaggagacactaagctatctcctagtcacttggtgttatattttagagcttcatttaaactttaacatcagcctcatatatgaaagaaaaaatggtttaaaatgcaattgggaatactgaaaatataggaataattaaatacatttattgtaagctatttgcagttgaataaacatttaaagatgaaagaaaaatccacttctttttaaaaggaagcaaaccctttcctactgagaaaagattaagtgggatgttcaagagtttaaaaaaaagaattgcagcttaagtgaaaaagtaacccatgcagttttggaagaaacgctgtcctcagaaggaagctttaagggaaaccagcacacataattattcagaaataaaagccttttttatttcctcaaaacttctattatttgacatcagatgttttatgtttttttctaggtctcccagatccaaatattccctagcaaaatttccttgaaaaaaacaccaagactgttcataaatcctatctatataatgcctattaataaatatttttctgtcctaaattctacatgtggcaggagagaaaccggatcctagcatacattttttttcccgaaaatgatttctccatggtaaggttcactgaaattctagcctatcatggttatggaattgtaaatgttttgtagtttatttattaaatctgcacattaaaaagaaataaaaatggccaggtgcaatggatcaggcctataatcttagcactttgggaggttgaggtgggagaattgcttagtgtgggagactagcctgggcaacatagcaagaccctgtctctactatatatatatatatatatatatatatatatatatatatatatatatatacacacacacacacacacacacatatacacatatatatatatacacacacacacatatatatagtgagccaaaaatacaatttctccaccatatatatatatatatatatataaaatatatatataattaacctgtgtggtggcataggcgtggtagtgtgtgcctgtggtcccagctacttgggaggctgaggcaggatgattacttgagcctgggaggttgaggctgcagtgagccgtgatcatgccactgcactcaagcctgggtgacaaagtgagaccctgtctcaaatataaaataataaatagaataaaataaaaagaaataaaatacatctcccatagttttgtggatagattatgacccagcatctggaagcaaacaggttaccaccctatgaagctcactgtttggtgacttagatttttggttgatgaaaagcctcgatactcacagttctttcctcatgttgatagcaagttttccccctgtaaatagccacaagcagccctatcctccttccatttagagctgttcacctatgaaaatagcaatcaagtattttccagttattcaactctctcttgcatacccccacctgctgaacagatcttcttgtggatctcatgaagatcctcttgactcctgcgtattgaaatgagccagagtttggagattgcctgccctatcttgctgcctttaatggcaatatcttcctcaagtccattttgccaccgaaatatctctctccccttcattgttgatatacctatgcccatgggcttgacaccgtctattgcccaaagttggtttttcctttcttctaacagcctccaaattgaggctcatgatgttgacaagacaagcttgatcctttgaccctgcaatgttctgctccttttaaaggcagtggtttccagccattttaaaatcgaggcatttctttcttcagataccagtgtctgaaatagataatacgaggctactatggggaaggtcaggtgaggggaagatctgtgttctcatcgcttccattccaaattctcatcatctcagagacttcttatcccatccatagtgctgtgaggcctttgatgggaaatgtacttttcaagatcagtgtggtgagtcggaaatagaataagagacacccaccgtcacttaaattttctggcagtgacattaaagtatgtgaaaagagacaggagaatctaactttaaaatatatattatttaacctaacatatgcaaaatttaacgtgtaattaatgtaatcattattaatgaaatagttaattttttcataccaagtctttgaaatccgtggtgtattttccatttacagcacattacacattggacctgcagcattgcatgtgctgaatagccccatgtggttagtggctagcatgctggatagagcagtcccagataatatagcctgctgtccttgaaaatgtgcaaatgacccccatgacctagtccctatctacctcctcaatctcatgtggttatgtatccacaccatatgctataagccagtggaattaaaattattgtgaattgttggaacttgccaactgttgaaaccacctttgcaaaattatgacagtaagagaaatctaacacacatgactccatcttgcttctaacctccaagctgtccttggtcattcttgggcacaggccaagctaactttggaaggaatttagtttatagtttaagcttaaagcaaggatgataacagccctctccaaaactatccatttcttttttggagactgaaactacctttgtgaaaccactgaaagggcacaagatcagaattatggctcagccaggagttgagaccagcctgggcaatatggtgagatctcatgtctacaaaacatcaaaaaactaaccagttgtggtggcttgtgcctctcgtcccagctacccaggaggctgaggtgcgaggattgttccaagagttccaggctgcactgagccatgtttgtgcattgcattgcagcctgggcaacagagagagaccctgtctcaaaaaaaaaaaaaaagaaaaaaaaagaattatggaattacggcttaggaatcatataaccagaggtcaaaagatttataatctctccagttgctcctacagataataatactattgaaaaatgtaagattattgtaccacctagactggtaacccatgccaagaaactggctcaactaatcttgtgatctcaacccaggaactgactcagggctagaagacagcttctaccatctatgattccatccctgacccaatcaatcagcattccctattccctagcaccctgcccaccaaactatccttaaaaaaccctagcctctgagctttcagagagactgattggaataataaacttccatcttctggttggctagccctgcattaattaaactctttccctactgcaatactgctgtcttagtgaattggtgttatctgtgcagcagacaagaagaatctattgggtgataactctctcatgctttttttttttaatagtgtttcactctgtcacccaggttgagtgcagtggcaccatcatggctcattgcagtcttgaactcccatgctcaaggaatcctcctgcctcagcctcacaaaaagctgggaccacaggtgtgcaccaacatgcccaactttttttttttttttttttcatagagacaggatcttgctatattgcctaggctggtctcaaactcctagcttcaagcaattctcctgcctttgcttcccaaagtgctgggattacaggcgagagccactgtgcccaccccagacatacgtatttctgaaagacttttccctttccctgaggtacctggtcctatccacaacacatgggattctgactaactcaaatatcctttgcaaacccattcgggtgtgatttctcacataagcctttcttatttctccagagttgacaccgttccctttcctgcctgcatctcgtcataaacgtattcaataagaataaaaacttaagtgttctcgttacttattgatgatttagtatgaaagaagacagcaatacatttacaatagcaccaaaaatttatggggtacttagggataggtctaacatagccaaatctcttgtcaaaaaattattaaaattatatacttaaaattatttaaaagtgcatttgagtaaatgggaatgtattcaatgttcatagatgaaaagatccaataaagatggaaatcatttccaaaatagactcccaagtaaatttaaatctatcatgttctaagaagggtttcgaaaaaaaataaaaacaagattcttaaaagcatttgaaattgtaaggagcaatgtgaaccatggaaaatgtgaagaaacagcaattttggacaagtaaaattttacccaagagttatatcaattgaaatgatgtggtgcttatgcagggatagaccattaactcaatttggaactgtgagagcccagcaatgagttcactgaaaggcaaaagtacggcattaacagaggagttatcagaattcagtgggtagagagtggaatgtttctgcagagctggacatgtagctattcattgtaggagcaaaaagctctggttcacagaaccagctaaagattcacagaagatcactggcatgtggcagattgattaacagaaaacaaggcatacaaatttatttatatgcaggggccttcagaatgaagatccaacttcccaatcagggccagaaacttaaataccatcgtgaggtgacagaagggatgggggtttgggtcatggtaaaacaggtgatgggaggaggagaggaggaattctatcgaggggcaataaatgattagtagggagaacgatttgatctggagacagagatcaacttgtaaatagttttttctttttcatttaaatgatccttggagacagtcattatcttgtaaaagggtctgttctggtgtaattatatttttagtaatagataatgagacaaaaggagaggaataagaagaattgttgtccttggtaggtcagtcctgtccttatatagatgaggacattatcttctaatgctcgttcgtctccaggagtttttaattcaaagtactcattataagggagccatatattggggtgaaatattttcattttcttcaccatgagaaacagaaaaagaaaattaagtctaaatggatcagagatttactagtgaaaagaaaatcttcatgtctttgaaagaaaccaacccggataaacttgtgacttcatgataggaaaacatatcttgaacattataaaaatgacccaataagtgagcagaatgattttttttgaatctatgaagtaaaggtttaaattttaattgacatttctcccaatgtgatgagtgatagcttatttgtaaattaaatagcatttttttttttagacggcttctcactctgttgcccagcctggagtgcagtggcgcgatctcggctcactgcaagctccgcctcccgggttaacgccattctcctgcctcagcgtctcgagtagctgggactacaggcgcccgccaccacgcccggctgagtgttttgtaattttagtagagacggggtttcaccgtggtagccagaatggtcttgatctcctgacctcatgatccgcccgcctcagcctcccaaagtgctgggattacaggtgtgagccactgtgcccggctgtgagcagaatgattttatgtgtgtatgtgtgtgtctgcatatgtatagatgtatatatactctctgtatatatatgaatatattctatatattagtttatatgtaagtatatagattccatatataaatatatacatttatagaataatttataatatacatttctatagtatatatttacatattattttagaagtattttatgtatagatttgatatgtatttatataaactatataaattcatatatagagaatatatataaaaatatataatatataaatatataatttataaaatgtatcagtatataagtataatataaatcaaatataaaaatgcataggatatagaaacacatgtaaaataaaatatacatgatatatgatatataaatatgtcacataaaaatatcacatatatttatatatattgatattatatatattatatagatattatatagcatacattttatataaatatggtatatttatttcaatatatcatatttacataaatatatcacatatttataatatatttatacatataaaataatataaatatatgtaatataaattatatataataatataaatatattacatatataatatattgatatataattttattatattatatattgatatataattttattatattatatattgatatataattttattatatattgatatataattttattatattatatattgatatataattttattatattatatattgatatataattttattaaattttatatataattttattatattatatatataattttattatattatatataattttattatattatatatttatatgtaattttattttattatatatttatatataattttattatatatatttatatataattttattatatatttatatataattttattatatatatttatatataattttattatatatatttatatataattttattatatatatttatatataattttattatatatatttatatataattttattatatatatttatatataattttattatatatatttatatataattttattatatatcatatatttatatatggtatataatatatattataaattataagcatattatatataaatatgatatatttatataaatatataaatatacatggtatacattataatacatataaatatgcataataatatatttatattaccttgtcccttcaccattggactttattttaaatcacaagggacttttcatcctttaaattatcagatgttttttacacctgactgagaggccagcttgacttgcaaggctgccttccaatagggccattgtgccccacatcttcagtcgcactaacctgccatgataatatcacacatgctaatgagagtctgacttaatgcttcagagtcaaatggctttactttattacacgcaaaattagagaatgagaacaaccgttctctatccttggccatttgccacaatatctgcattgaccttcagcactttgccaaaatcaatttatagataggatgaagaggttttttttaagtgctttttgtcttgccaatgaaatttttcttaaattagttcaaaaacgtatttgtatgttagagatgtgtccatctgccagactttgggccagacgttgcgggcacaaggtaagaggctattgatttgataaagatggagacttttaattcaaagatgttgtaattcacagactcttctcattggagatgcacataatgtataatttaagtgcaaactccttaggcagtgagagtgaagaggaaatggaaaaagggaagaagtttttaagagacagatcaaaccacagatggaaaaccactcactagaaaaaaccctttgagcagttgctttctccagttacagaattttgtggtcctaagcccccatgccatccctaatgccaaaaaataaggcttctacactccactatgaataatggtttaactcctccttttaattaatgccagaaaagaactagtatacagaaaggccatttttgttccgctggcaaaactatgcccatcactgcagcatttttatttaatttcatgttacaaaactataattctacaacacttttgattctcagatggttttaaaaatggaagtctccctgtaaaagctctcttctcttgtctgcttccatgtgagaggtgtctttcactttccaccatgattgtgaagcctccccaaccacatggaactgtgagtccaataaacctctttcttttgtaaatttcccagtcttggttatgtctttatcagcagcgtgaaaatggactaatacaggaagtttttcaacacgggtctcccttcttcctcacttttgggatctccactgtttgttgtttctacctttgtgtccatgagcacccaatgttcagctcctacttataagtgagaacatgcagtgtttggctttctgttcctgctttaatttgcttaggatgatggtctccagatgaatccacttggctgcaaaggacatgattgcattcttttttatggctgcatagtattccataatttagatgtaccacattttctttacccagtccactcttgataggcacatgagttggttctatgacatgtgcgttttaattccccttcctgcttcggttttttttttttttttaatagacatcaaggttttttcattgttgggttcctgaatgctggtatggaaagtggctcaaggtagtcatttttctcattagctatatggaaaatgaataaaaaataatattgaaaccagatttattttttgaaatgctggaatgcttgatatttgagagagaaaaactaaatgcacatttattttatgaaatagatccatattggttagaacagaaagtaatagttaacccaaatttatggctttacactttctatctagatctcctattcattgctccagtgccagaagaaatcaagccagtctcatcaaacaaaatatctcatgcatttaaaagtctaacttagaatttttctgcaatgcttattcaggcaattaatgaaggtattattaattatagaaattgttaattaaataattaatttgttaattgaataattttttacaaattgaaagagtctttgaacttacttcaaggccaaatatgatgtgtatggtattaatattttggatatttttgaaggtgttgtattaaatgtagcaaaaaaatgaatccagtatgtaactacaccaaaagcaatctcttgaaatttttatcaaatatgccactttg[355 bp omitted]ggtagaacagacaaccacgtagaagtctctgtttagagaaaagctgactcagaatcaaggaagtcagttttctgatcatgacaatttttggatgtcgttttgagaattatcagatgctatgagaagggaaatgacctcttatttataactcttgatctaagagctctcgtcttctaactcatttctgactctacctgtttataactgtatgatacaaaacaaaataagaaaaaacattagtagaaactgagttgttatttgaaattaattgtattaagttgaaagccacaaagtgtcattttttcttttgagttatggagttcgtaaatgaagattcaaatgtggtttataagccttatgaactattttatctatataaaataagtccttccgctagttagataattatacactaaaatatagtcatattgaatgcctatgatgaaatcacagggcagattctaactatggggtagaaggattttaaatgtttactcacacatggcatagatatgctgtttgcactgttattttctgtgcagatacatgcatatccttttcctgtaagttattttggaaccatgtcagaagtgggctgtgagctcttattgataaaagaagtactgcatttcaatagaagatatcattatctgcaaagtgaaatgactgagctggttccaccagtgatctatcaatcacagcttcttgtatattgacatgagccagcacggcatcactgttcagatagctaacttcactccaatcatgccttagatctaattttcacctcaacaggaattaaagggtgcatgggtacatgttaactgcagcaggtatgatcagatgcatccaggataagtgaaggtcattttataagtcatgtcagatcacccctcctccccaccaaaaattataaaattagataaaagtaggaatggagtggctattccagttaaaagaaactaaaaagaacaaatgtaaagtgagatattttattggatacctctgatgaaacttggatatcaatagtgacattttatgatagtggaaaatttactttgttttcatttgatgtgttgtagcattgctgtgatgcgggaaaattttcttttacctttggagagaagcatacttctgtatttggagggtgaaatgctaggattgaattggttaagaatacatgccaataactgactatatctctatgaatgcatgttgatattctgtatttctaagtctggggaatactcacggtccatacaatgtccattcacattgtatggagacattttgaaagggtctgattagtccattttcatgctgctaataaaaacttagccgagactgagtaatttataaaggaaagaggtttaatggactcacagttccacgtggctggggaggcctcaaaatcatggtggaaggtgagggacaaaggcacatctcacacggcagcacacaaaagaacatgtgcaggggaacacctcttcataaaaccatcagatctcgtgagacttatttactatcacgagaacagcatgggaaaaacctgctccggggattcaattacctcccaccactgggtcccttccgcgattacaggtgtgagccactgcaccagccttagatttttcttaaaattcaatgatatggattaaatgtgccattctttccacttttaaataattgcgaaaattgaagacaacagataaacaacataacacctggcttcagaaagaaagaaacactgattaaagaatatatgtcattatgatatagatgaagtttgagtagaaatctaaaaagcagtggaaggcagcattgtttactttgggaaaatgacataagcccagtttaatctttaaaacattactttggataactgacatgctgatatcatagtaaaattcccagtacccctgagctaaaggccacgcactgcttattaagaaccgagaaaaataactgccatatttgttccaagctagaatacagaaagaaggtcttataggtatttcaatcaaattggaccagaaatgggacagagggaaactatcatgctgcacttttaggaataattcagtaacatttggagaaataaggaaatgagagctatggtttgagcttgagaaaaataatctctgtttttgtctacagtgtaggagagagaagcacctgtgtccaatgggaaatacccaatcggagtttccagggaaggaaaagtacagaagccttctagtaaaagattcttcctagaaaagaaaatagatctaaattcattcagaatcctaattgaaagacaaatgaaaagattctactactgtgcaagaaaaccttctaattcagaacaattccatacattatgttacttaagagagaataagatgagtttaaaagttggatgtcctggaataattaagagaagcttctatgattgccaacagtgaaaccagaaacacaacatactacttgataagtgattaaactctcataagttctgtttgtgtaaattctgcttgggtggcagtttcctgtatgattgaactaatttttgcatgcattagcctatgctttttggagctataaatagaactgtacaatttttattgaaatatacataagtgaaagtcatggttttaaatatacaatttgtattagtccacttttatactgctatgaaagaatacccgagactgggtaatttataaagaaaaaaaggcttaatggactcacagttcagcattgctgggggcttcaggaaacttacaatcatggcggaagaggaagcaaacatggccttcttcacatggtggtagcaaggagaagtgctgagccaaagggggaaaagccccttataaaaccatcagatctcatgaagactcactcactatcacgagaacagtatgggggaaaccgcccccataactcaattatctccacctggtcccacccttgacatgtgtggattattacaattcaaggtgagatttgggtggggatgcagagccaaaccatatcataattcaatgaatattctcaaatatgtataagtaggtatgcattaccaacaccagaagaaaacatgaaaagtgtattcctaccacaccagaaaaatgactttctggtaaaccccttttatgcccagaggcagacatgattctgtcatttaacatcccaggttagcttctttgctcttgaaattttttatgaacagcatcttatagtaggcatttttttttctccagccccttttactacacataatgtttaggggattcattcactttgttgtgcctattacctttcttaaaacattttaactattgaacagcatttcattatatgaaaaacattgcagtgtagctgcgtattctcctattaaagggcatttggctgcttttaccttaaggcctgtacgaaacaagttgaaatgataattcatgtgtgtgtccataaacacctacgtgtagaatgaagtggtcatgggtgtatatgtgtgtaatttgttgtatgtatatatatgcccatgaacgtggtcaaaatgggcaaatagtttacaaataaatacagatacaataggaaatatgtatgtggcatatgtgtgtgtgtgtgtgtgtgtgtgtgtatgtgtatatatatatatatatatatatatatatatatatatatatatatatatgcacctggtcccacccttgactcgtggggattattatacataggtatatgccatgtgtatgtttcctataatgcctgtacttataaaatatttagtaaaaagtatacattcaaatatttatgcatgtatacacaaacatattaatatgaataaatcatttacgttttatatctgtgctacacaaatgatttatttaaatatttatggatttaaatgaatattcatgtatatctatataatatttatttatatatatttatatagtccttaatctagataaatttcattttattgatatatgcatggtgaataactttttccaatagatgtggggtaaatgaaacatagtatgtgacaatttgtgagatggacctaaagcaatgacaaatacacttgcatagcatcgcatacacatcctaaaagataagtgtattagtccgttttcacactgctaatagagacatacccgagactgggtaatttataaagaaaaacaggtttaatggactcacagtttcacatggctggggaggcctcacaatcaaggcagcaggcgaaagccacgtcttacctggtggcagacaagagagaatgagagccaagtgaaagggatttcctttctaaaatcttcagctctcatgaaacttaatgactaccacgagaacagtgtaggggaaatcgcccccatgattcaattaactcccactggatccctcccacagcatgtgggaattatgggaactacaattcaagatgagattgggtggggacacagccaaatcagatcaagaagaaatgtgatatattaaggaactcattttatcaacttaagaagctataaaaagaagagccattaaactcagagatgggacaggagataagataatgaaataatgaaccgaggtccaattaaaccaaagcaagtgaaaggaagtaataaagataagaagtaggattccactaaagagaaaacaatagagatatttaagagagcctaaaagttgtttctttcaaaagatcaagaaaatcaatagaccctgaaagaattgtagcacctgggaatatccttgtgtgagaccccagagtcgagctaaagcacatttacatcaactcagagtgttgcctattagcatttggctttctctgtccttcatccttaaacccaaccatcactatcagtacacatctgttttgcttttactggaattttcatagccatgaaagcttcagtaggtattcagttgtccccagataagcattgtatttttgatgttccatgatggcgtaggtaccagaagttccttagactttatttctgcagagaattccgttctatggctaggctacactttgtcttttcctcagccgctcatggacatttgagtcatttctagtttctagcagctattactaaggctgctataaaaattcacaggcacgttattagagaaaatacattttttctctcttgagcaaatatctaagagtgaaattactgtgtcatgaagaatgtttatatttagcttgataagaatatgccaaaccttttttccaaggtggtttaaccattttgctgggtgcaatggctcaggcctgtaatccaagcactttgggaggccgaggcagatggatcacctgaggtaaggagttagagaccagcctggccaacatggtgaaaccccgtccctactaaaaatacaaaaattagctgggttgggtggtgcacacctgtagtcctagctacttgggaggctgaggcaggagaacccaggaggcagagtttgcagtgagttgagattgtgccactgcactccagcctgggtgaggaagtgaaactctgtttccaaaaacacaaacaaaaactatgtggtttaaccatttactttcccaccagtaatgtatgagaatggtttgccaatattgtgttactatttttcattttacccattttaatatgtgtgcactaatatttatttttggatttaatttgcatttcactgataactaatgatgccaaatatcaattaatatgtttatttgacatatatacatatacacacacacatatataatgttcttttacccaatgcaaattttaaaaagatgttgtctctcatcatcaagttataagtttttgttttagataccccatatacaagatccatgcctgttacatgagtcgctaatggtttttccccagtctgttacatatatatagtaacagtgtcttttgaaaataaaaatatttcaatttttattgtctatatttaaaaaaaattttttgtggtatgtggggagtgtgtgtgtgttcagtatgagatctttgtttaactcagtggtacaaacacttttctcttaaatttaggtttagcattttatattttaacattaacaggatttattatttatgcagttagtttttgtccataatgtgaggaaacttgaggttcattatttttttcccatttggatacccagatgggaaaatgtcagccttcgtaatgtacatcaaatgcatagtgattatactcctctacagttttctgagattttgcataagattgaaataatttttttcttaaatctctgatagacttcatcagaaagccacttgaacctggagttcctttttcgaaggtttttaatattcacatttgatttttaaaatgtatgtatggcaattcaagttttcttgtactaacatgcactttaggtaatgcgtgtttttccagaatttgttcatttcagaaaggttgtccatagttcattggcataaagttgttatccatagttccttactatttcctcaatatatgtatggtgtcttctattttattactatattggaaattgtaaaagtttctttgttcttgacaagtcttactaggtatatataattttcattagttatataaaaataactttttaaaaactttaaaaaaatttttgaagtagagactcaaagaagttgcaaaaatgattcagagggtcacctgtatcttttatacaatgtgctgaatggtaccatcttctgtaactgcagcacaatatcacaatatcaacacagggacatcagaatttattcagtgctactgttaattatactacagacttttttcagacttcaccagtttttatatgcactgtgtgtgtgtgtgtgtgtgtgtgtgtgtgtgtgtgtgcatgtaaggaaaaatcaacatttgattttaattttctttaatgattcaatattctgtttcaatgatttactatttgtttttttcaattcctccttatattccattaaatttctcgtttgttagctttttaaacgtgaaaacttagttgaatttatgtttgtttattcatataaggatctaaagaattagatattttctttaatttctgctttgcttgcatatgacaaattgtgatatattttgttttcattttcttccaactcaaaatatttttccaactttcccgaagatagcttctgtgatcaatggtaattaagaagggtgttctttagttcctaaatatttgaggatattctacatatacagtgtttattgacttctaatttaacgtcattgggattggtaattagcataaaatacaagaaaatatttgatcaaaatagacagtaaagaaaaaccagaggagaaaggaaaaatatgttgaaagaagtgcaaaacaaatagtaaaaatgagaggtctttctccaaatatatgaaaaattgcataaaatcacaaggcataatttaccaaagagaagtaataagatgtaaacttatgctattagctgggcatggtggtagatgcctgtagtcccagctacttgggaggctgagggaggctgacgtgggaggatcgcttgagcccaggagcttgaggctgcagtgagccataattgcacctttgcattccagcctaggtgacagaacaagaccctgcctcaaaaaaaaaagtttctttaaaatttatgctgtctacaagaggaatactttaaatttgaagaaatgcattggttgagattaaaagaatggaaaaaagatgtgacataacactaaagatggaaagctagaaaacgtatattgatatcagaaaaagtagatttcaagacagggtgtgctactttggtaataagagactttgcatgatgacaaagctcagtgtatccaggagagatcgaaattatgaatgtatatgtgttcaatacaatggcttcaaaatctgtgaatgagaaactgagtaaataagaaagatagacaaaaccaataacaaaaaataggtggatattctaaaacaacagtcacagtaattgatagaacaaataagctaaatagactaaaagacagtcagtatagaatatctgaacaatattattcaccaccaaacgttatttatacttactgcatagacactaaaaatttccagaatgtgcattttttttcaagtgcacagggaagtttaactaaggtagactaaccctattctgggttataacacaaaatagagtacacttttatgcaaactttaacttttaataagcaattccaatgttttctgtcctgcattgttaccaaggggaagtcagctattattcataccattgttttcctgtatgtaccatgtcatttttgttttcttgctgatttcaaaacttctccttttcatgtttgtattttggatgtttcacccaagaaaaaccactgacaccctctgaccctccttttctcatcttctagcatggtaataataatattgatgactttggaaggattacagataatctacctaaagtggctactctttatgttgtatttcaagtcttctaaaagaatgaaagttcagttccagtgattgtggtcttcctccgggaacctaggtactgttgagctccacctactaaatgacttcacactttaaagtgagccaaggccctagtcaaatacatctcaatggactactagttatccccatgatatgcagtggagcagaagtcctgtccctgatggggtgacctccctggttttcagcaccaattctatcaattagtaggtggacccatgtttagtcctagatgggctagcatgatatgagccacttggcctagcttaagaggaatgcattgctctttctatattttcctctgtgatgtggattggctgtgtccccacccaaatcacatcttcaactgtagctcccataattcccatgtgttgtgggaaggacctggtgggagataattgaatcgtgggggcagtttcccccatattgttttcatcctagtggtctgatggttttataaggggtttcccctttcacttggctctttctttcttgcctgattctatgtaagacgtgactttcaccttctgccatgattgtgaggcctccccagccacgtggaactgtgagtccattaaacctgttgttctttataacttaccccatctcagatatgtgtttatcaacagcatgaaaatggacaaatacactctggttgcctgatttttttctggagtatgccatccttgaaatctgaattttgacatagaaagaactgagagttacatacggattttgggaacatagaacaaaggaaatccctttcaaaaatctgccttatttctggcttaggtggcatattctttcccatgaatcaatttagctggacagcattctacattatgatttgaggtaaacctccatccattgataaagtgattttaacattgtctggtctcctgtgattatagtttcctcagggtttgctgtcatggggtaggatttggaagatgtagtagccttcccagagaaaacgttattttaattttactttctcatattaagtaaaaagtgactttttatgatttcctcttggtgttccttctctcacacagacacacatatgtacacatttctacatatacacatttgtataaaatcttttatatatagttttatatatgcaaaatctatgtatacagattttatatatatagaaatctatatatagatgctatatatagatttctatatatttatatatactgatatatatgatagaaatctatatatctagggagatttatatatatatatatagagagagagagttttcatgacataaaacaagaagcttgtttcttctataatcctataacaaaaaataaacatatattacaaatttatacttgaacttgtagaaaaagaatgagagaaatactcaaaacattatatattgaaattgctacaagatatctggcaacatttctggaaatattattttggggaatatgaaaagttttgagctgggtaacaatatgagcacattattctgcagctgcttgagtgacagtcctcaggaagtgatgaggagtgactctttatggcttatttttaagctgttggaagttccttagggctaactgaaaatgcgtcttctctggattttccctgtttgacatgattgtccagagcttagatgaagacataaagacatgttcatcctacatggcttggagcaatattttatattgtagagaaaatgaaaatgactggccaaaatacgatgaaactgaacagggaaagcataaagttttaaatttcattttttaaaggcagcattgaggactcctagtttaacagtttattaactccatttgatagatgcatgctgtcaagagaaagattaccatctcagattctgattagatcatacccagggtgatgcatttatttctgatggccacattttaagacacacattgtaaaactacggcaaatccagaaaaaagtttccgtgaggttcaaaagactcacaatagtgttatgtgaggatctattgaaggattccacattctttcatttatctattttttaaagaccgggtgtcactctgttgcttggttaggggaggtcagcatcggagatgagtctaaaaatgatcagctgtgctgaatggacagctcatgatttgaccacagactttagaaagcactgcctgcaaagcaaaacaaagacctgccattttctaagaagctattattaagtc[138 bp omitted]gcctc[211 bp omitted]aggaaatgctttacattagagctgttttagagtttttgtttttctttaaatttcaaaatcaggctgttggttaccaatcacataaggatacacaaatataaaagtataaggatgatgccaaatacatgtgagtttgtatattccctggagcctgaatttggtgtattgctatgactgtcttcttgatggaactaaaaagggaaaaagagaattgaaattaaggaaaaatacccccaaacatagaatggtggttaccaggagtgagggggtgggggttagaggattgaggaaatgttggccaaaggatagaaagtttcaactagactgagggaatacattcaagagatatactgtacaacatgataattagaattaataactatgttttgtacacttgaaaattgctaagagagtagactttaactgttctcaatacaaaagtatgataagaatgtgaagtagtgcatatgataactagctcaatttcataattccacaatgcatacatatataaaaacatcatattgtacctcataaatatatatataattttttatcaattaaaaaaatgatagaactatgccacattgattgatgaaaatttcacatgagatctctctttttacacatataaataatgcattcctcaatagaaaatcactttgtggattgagtcaagtcagttaaagtaatcaacattggaactttatggcttttgcaaagaaattgcctaatgccaacagaaaaaaaaaaagcaaagcaaagagccacataaatgatattgagaaaacacactgctctaaccaagggcttgagtcagcagcaaatgggtaactgacctaggtattggccctaggaaataattttctaacatagaagaaggtacggtaacaaccatgtccctggggaggggcagggtagcaagatcctagctgcaaacagatctactcaaaagttttaaacaagagggtttaatgaaaagactatttataaagaagattgcacttcttcacacctttgggcaatttgcaccctcggatttgcactagcaagattattacgttttaaccaaccttggcagtaaagaaaaagggaatgcttatcagagcctgtagagttctgatgtgctaaccagagccatggaagacctgataagcagttctatataaggagacaagccctaccgtgtattgaaacatattgacaaccctgtttaagtaaaatattaatagtatccaaatatggagtgacagacaatttcaacagaatgaaaagtccagaaatacacccaaatacacatggaaatttaacaaataaaacaatgatattgccagtcagtagggacttcttcatatacacttttgagaaactgaaataaaatagattccctacccccacacaatgcacaaaaataaaatccaaatgaattacaggtctacgtggaaaaatttgaaagtgtacaattttatcaataaaaatgaataatttttctaaaacctggatatgtaggaatgctttaaaagtgatgcaaagtacaaatgcaattagatgatggatggatgaatagatagatagatagatagatagatagatagatagatagatagatagattatgggtacatagtagataccatttctcaattattaaatcagcaaaattataaaagtttgacatcacattctggtgatgaggctactggagtatgtctcacacatacacagagagtaataattaaaaacggacaatgtttatggaaatggatttgacaacttgtaccagagctacatatatttttaccctttgaccaacagtctcacttctgggaaattaccactgaaaacataccctgataaatgcaaatatacatatttacaaagttgcatattcctacattgtctgtaattgcaaaatatagaaagttgtataaataactgactataagagattgtgtttattaaaaagtgcatatatacaccataaattatcacacatttgtataaaatgagacagatatctattgaccttcttagggataaaaagcattatttttacaaattatttttaaatgcttcagaaaaaatgattgattatttagataaataaatagatgttagagatgatgatagatgatacagatagacagatgagatgagatagatagatggatagatagataggccaatagattggaaagatagatgattgattgattgattgatagatggatgatagatacttgatagatagagatggataggtagatagattctctaagagttaatttaaatatttgttttctgacttaataaatgctagatatgtttgaataaatcaaatattacttttaaaaagcaataaatgaaacaaagctagtgttgaacttccaacaataagccctctataaacagatctactctttaaaatatcagtgaaacttgcataaaaataaatacttagttaattttcagggcaaaatctatccccaccagtcaatacaaataaaacagcatccaaataaaatgtaaagttgaaagcttagcaattaagatgcatacttcctaataccaccatcaaagaagcaacaaccactgattcactatttaccaaagagagacagttgtcagtacatttcccaatatttcctccaaaaacaacacagaacaactaaaaggacaaaggcacctgcaggacacccacattcccaacatgaatctatgacagagtatgcctgctcttcaaaataactgtaagtataaataaataaataaataaataaacaaacaaacaaataagagaatcctctgaattccagagatccatctcttgtgctgagaggcaatgatgtatgacctggccagatgtggggaagagagaagagaaaaaataagagagctcttctacaacttctatgggttaccatgagaatattttcaaaattattaattaaaacattataatgaaaggagatagtaccacatcatggacttcattacagtaaaaatggaggagatcagactctggcattgtcactgactgatagtctgttggtacacacctcatcttcctggcatttggattcctgaattctaaaacaagttgatagattgacttaattgttggacaccaccccatgaattgtcttcaaagggaccctctgatgatccagaagtgcctgtatgaattctttcagggagatgattacagctttgcccagtctcaatgttatgtctggctcaaacaaagacaaggaccactcagccggtgaatccactgttaaaagaaaaacttcagccaaattaaatttaaaggagtttaattgagcaatgaaggattcgcaaatctggcagcccccagaatcgcagcagattcagagagactccaggggtgccttgtggtcagaacaaatttatcaacaaaaaaaaagtaaagtgacctacaggaatcagaagtgaggtacagggcaactggattggttactggttggcgtttgccttgtgtgaacatagtttgaatactcagctgtctatgagtggttgaagtaccgccgctgggattggccaacactgagctattgttacaggtgcatacttctatgttaggctttcaatcttgtctacctattaagttaggttgcagttcatccacaaggactcaaatatagaaatacggagtccttctcaggccatattcagtttgcttaaacgccacgaagtgcctctcagttctaacattgtctgaaaactggggctcttgtagatc[222 bp omitted]gctgaggcaggagaatggcgtgaacctgggaggcggaggttgcagtgagccgagatcgcgtcactgcactccagcctgggagacagagcgagactccgtctcaaaaaaaaaaaaaaaaaattccgcacatatttgactttgggatttggctttggaaatatctaattcaatttattaaattatctttattgagtaacttttctaagctaacttttttgttgttctttgataaatacttcaaacacattgtgccattctaccaaaagggaaacatgcactcaggtaattgccttggtcaacataaattctctcctctggtgcatttatgatttgttcttcctacctcttcattccgccaaaattaaatgtattggttgtaagctacaaagtattatgtatctctatttctgataaactcagacattgactttgaacaatctaaaaagaaagataaaattcccactttttaatcatgcatcctttcatattataataaaagcacagtttatcctttcatatataatacatataattatataattgtaatctggaagttcccattgcgtatttgcctctttattatagtttctcaatattttcactccaaagacaaaaaagaactgaaatataacgaccaaaaaactatccagctgcataatgaaatcgtagctcaaagctataaccaacaaatatgattctgaaaagctattttgcctgcacaatataactcaataacaatgctaaatgcttttagtttggggaatacttatgaatgcttctataatgtttgctcaattctgtaagcagtatcctgacagttaaaatcaaacccgctattctagctaacaagggaatagacagccctgttccatgacaatctttgaaatgcagcaatattatccattttgggtacaataggtttaattatagggtcattgtagggtattttagatactcagtaaactgttgtgagaaagggcgaattttgatgtcaacttaagtgaacccttttatttctccccatcatttgtaatgtgtttattacaaaatctatctagtttgagacagaactgcatggctgaatatgtgtttacttttcctactgccacgtatacatactgacattcagaacattaggattttttgtcagttatgcaaaagatgaagaggcttagttcttaatatcaaatgcaaagacagatgttgtccctaagctaatataacaacgttttaaatgggacctgtggcataatattacagcacaaatcattatggtatattttataattatgcattttaatggattcaagtaaatcctgcttcgattacattttgctccattagacaaagtatcacaatcaatgttcagcttggctcttatttgtttactttttatgtagtgatgagctgaaacagtccttaagtcctcacccttgttcacttaatgactacctataaactactgtggcactggtgatacttcaactcatggatgggaaaatcgagtcttacagcatttaattttcatctcactgaaactaactttgcaaaaattataactgaggaaattatgacagtgaaagaggtcagacctaaccaactccatcttgcttctaatctttaaactgtccttcttcattcctgggtgtaggccgatctagtcttgggaaggaattcagtttatggtttgactctgaaacaaaattgataataactctttcctgaacaaaaaactcttcgtgcctgggaccagtctgcctttgtagtattaacaaattagctacaagattagaaattacagtttagaggtcatatagcctttggctgcaagagtctgaacttcctcaaattgctcctggggataacaccactgttgtaaaacctcagatcagtgcttgaggtattttgcagaccctgcactggatcgatcagctgacatcactcagacaggtaatctggctcaaccagttctgccaccccacccaggaacagaaaacaacaagaaaacctcactttaaccccctatgattccatctccaactcaaccaattagcactccccacttctggagcccctacctgccaaattatcctttaaaactctggtcctggctggatgcagtggctcatgcctgtaatctcaaaactttgagaggttgaggtaggctgatcacttgaggtaaggagttcaagaccagccagttgaggtgggctgatcacttgaggtcaggagttcaagaccagcctggccaacctggcgaaaccctgtctttactaaaaatacaaaaaaaaaaaaaaaaaattaggcttggtggtgcttacttgtaatcccagttacctgggaggctgaggcacaagaatcgcttgaacctgggaggcagaggttgcagtgagccgagatcgtaccaccgcactccagcatggatgacaaagtgagagtctgtctcaaaacaaaaacaaaaacaaaaacaaacaaacaaacaaaaacacaaatgagaacaacaaaaaaaaacccctctgatccctgaatgctcagggagactgatttgagtaataataaaactcgggtctcatgcacagccagctgtgcatgaattactccttctccattgtaattcccttgtcttgataaatgggctctgtctaggcagggggcaaggtgaacccactgtatgtttacataactagtaaatggttattcttatatctcaatccaagcagtttcaccaaggatcttgtgccttcatcgttaaaatgtagttatatatttttctaattcactacaaagacacaagtattataatttgtacccaaaacttcctcttctaaaccaacggacagaagggagaagaggatgtaagatacatgtaaggcagaaaggaaatgtaattaaaaatcgagtatccaggaaagtcaaattatggagagggacaaggtttggggctacaaaggaaaaaaataaatagggagcaggtgatgttgactatggaatctttaaagataaaggttctatttgggtaggtgaagtagtgaaaggtggtaagagaggagaaaggaaaaaaacagtcaggcaggcagttagcgtgggtcctccgttgaatcctttgaaacaaaggaacagcctgcaggcagagataagggaagttacacagtggggcttgcccaagacatgcccgcagccacacagataagaaaggctacacaggtgacttgcccagacatgcaagcaatggaaatttccatctcctgacacatgcccagtaaatggaacaaaacaatacggactaactcaagctaaggggccgtgtgtgcattaggaggatggggtagagctactagatatgtgtgccttatgcaaatgagaggcccagacctcactggtttcttataaaagcctttgcattcaattgtaaaaacagcaaccctcttccaggtcccctctccgcagcagagagctttcttctttcacttattaaactttcactccaacttcatcctttctgtccatgctccttgattctcttagtcatgagacacagaactctgggtgatacctcacaatgagagactgctacaatgtggtgcactggcgagactgcaacagtgtcattcctgataaaaacaaaacattgagtaaagaaatggaggagggtcttggcaagacttggactgcccagtatggtggtgttgacgagagtccaactctgtaaaatatttgaagagatttattctgagccaaatatgagtgaccttggcccgtgacacagccctcaggagatcctgagaacatgtgtccaagatggtcggggtgcagcttggttttatacattttagggagacatgagacatcaatcaaatacatttaagaaagacagtggttcagtccagaaaggcaggacaacctgaagcaaggcgggcaggggggtgcttccaggttataggtagatttaaatttttctggttgaaaattggttgagtttatccaaagacctgggattaatagaaaggaaatatctgcaacgcaataagaggttatggagtccaaagttttattacgcagatgcagcctccaagtagcaggcttcagaaagaataaactgtaaatgcttcttaccagacttaaggtctgttgatgttaatgccagagagatgtaatgaggcatattcgacccccaatttccatcatagtctgaacaaatctttcaggttaaaagtgccctagctgaggaggaagcccattcagatggtttggggtccttagaattttatttttggtttacattggtcattagccatatgtgactactttaagttaattaaaatgaataatgattaaccattcagtatctgagttataattgctacatttcaagtgctctgtacccatacatggctagtggctaccatactggacagccaagaatagaacatttgcattatttcaaatagttgtgttggagagtgctggtcttggaaaaataactcagggtatagcagagcaaagatgcttctataagcagttaacttttagatgtatagtatgaagcaaggagagggaaaggtgtgaatgagtcaaatgtaaaaaaaaaatgactttaatgtatatgaattgcattaaaattatccctaaagtttagaaatatcttttttcaaatctcaagcaatagtttgtaaatgatacaaaaatattagcttaagaccatgaatacacataaaataggctttataaaaatagaaaaaatgtcattaaattttgaatgactgtttcatagtagatatttttcctctctaaatgtattaaataaattcaaattgtgtgtggatacagagccaactaaaatttccttgttctttcatagttctccccatttgtagtctataatctctggaattgaaaccacagccatttgctcttttttttgaacattatatttttagtaataatattaatattttttcttatctatttttgatacagggtttcattctgtcgcccaggctggagtgcagtggcaccatctctgctcactgcaacctggacatcccaggctcaaatgatcctcccacctcagcatcccaagtagctgggactacaggtgtgcaccaccacgcctggctaatttttctgtagagacagggcccaactaagttttctagtctggttttgaactcctgggctcaagcaatctgcccatcttagccactcaaaatgctgggattacaggcgtgagccactgcaccagtctgctctttttaattccttccaaatgacctctgatttttgggagttcacatgcttttcagattaaaacaaaaaacgaaaagcaaaaacaggaaacctattgctcaagtgatactaaaaacaacactatgagtttaaaaaataattttcaattttatttaattagattttcttctcatggtatccaagcaggtttaaaatattattggaaataaacaacaagtaaaaaaaaaatagacaaatgttcataatgtacactaaatataaaactaaagcaaaaatatagcattcttattttttctgccctggctgaataatgatattttaatttttaaaatacattgtcaacaacaactctttcctttaaaaattttccctacagaagagagaattcaggaccaagtgttgattttgtctaaagaagtaatttatagtaatggtaattacaacctacttacatatttacaaataaggattcttatgtactctttatttgttaaaaaaaaaaaaaaaaaattaataggtctcaccgtgttgcccaggctggtcttgaactcctgagctcaagcgatccacctgtcttgccctccaaacgtgctgggattacaggtgtgacccatggtgcccagacccaataagttttttgtttgtttgtttgtttgtttttttttgttttttggaggcagagtctcactttattgccaagctggagtgcagtggcacaatcttggctcactgcaatctccgcctcctgggttcaagtgattctcctgcctcagcctcctgaatagctgaggttacagacacccgccaccacacccagctaagttttgtatttttagtagagatggggtttcaccatgctggccaggctggtctcaaactgttggcctcaagtgatctgcctaccgcggcttcccaaagtgctgggattacaggcatgagccaccatgcctgcccccggccccatatacctttttaaattatggattattacttccttgtgagaacttcctggaaatgattcctgtgtaatgctagtcatggtgatacagacaggaggtagggaaatactgggtagaagtgggcggttccctggcaaaggccccacccctggaaaccgtggccctaaatgagaacagttatccctgtttttctgcccaaatgttacttttttggcccactctccctccctttcctgtgcccatataaactccagacctcagctggcagagagacaagtggcacatgtcgagaggagaagaagcaactgagcatcagagactacagatagacgcagcttaaattcagatggcacgacttcggagagaagcttgcccagagatggccaggcttcagggaaagatcaccttcttccgcaccctcccctttccagttccccttctgctgagagccacttccactgcttaagaaaacctctgcattcatcatccttcaagtccatgtgagctgattcttcctggaggcgggacaaggacccgggtaccaagagagcagggtgtaaaaggctgtcaccctgactctccactgatctggttaacacttagccggctgtggacggcaactgctaaaagaacattaattgtaacacactcctagacgccgccttggccttggggccagaactcaaaatcactcgccgcagctcttgcgcccgctcactggcatgctccccctcccacaagggggagtaaatgaaccacatccctgtcccaagtccatcccgcaagggggtcacgggaactctcctgtctcagtggggttttttgatgaaacatgtcacttttcatgtaaaatgctactgtgaattctgcagcatctttttgattttgcttttctacattgtagagaccacacacttttctctgagaaatccactgggataacagattcaatgaaatagctctgcttgacagaaatttcacatattcctcagagaaaatgaaatttccaatcagttttaagcaaaaatattcttttttcttgccccagctggtacaaatggaatctaaacaaattctacaaaggagcaagattgaaaatatgaattttgaagtgacagtcaaccagctatgtatatttttgtgttggaaagaattccctcaatacattacacctcaactggggccattaaacaccagaacaaccactgctttgacatttagcaccagaatccatcacatttggtaaaggaacaaatctctgtgggaaagcaattgtattcttgaaagtgtgtattccatgaattctctctacatttcagctctgtaacaccctgaacaaatgtgcggaatatttggtggtttgtgttttttcctccatattcttcaaacttttctttctttctttttctttctttcttcactgacttttctttcttctttctttcttttctttctttctttctttgtttccctccctccctccctccctccctccctctctctctctctctctttctttctttctttcttcctaggtctcactctgttgcccagactggagtgcagtgccacaatcatggctcactgtagcctcaagctcctgggctcaagcaatcctcccacctcagcctcccatatagcagggactacaggtgtgctccaccacacccagataattttttaacttttttgtggagatggagttttgccatgttgtccaggctggtctcaaactcctggcctcaagcaatcttcctatctgggccttccaaagtgttgggattacagccatcagccactgcacccggccttgttcttcaacctttctaagataaaccacacagctgctctatgtaacatagttggtggaggggagagtaactagtttctgaggtttattaaacatgctcgtaatcattataatttgattaatgacagtaattaaatgttgcatgcattgctacaagagagctttcactcatctaattagttaataacatgggtaaggaaaataaatgccactatgttctggtatcacccaactgaggataaaaatgtatcatcacactaagactatgccaatgactcaagttacgagtttaatacctgaaactggtcaacttttcaacaaatatatattcgctactaaatgccaatcatagttgttactattgaagatacagctctcaacaaaataaagatgctgctttaaataatgtgttcacacattaattgaatgtgtaggataaatgcaatttatgtccttttgtctttccttccttccaccggaagttttcaagtagttaaataagttattccgggaacgtgaccaatgaaccccaaatttaaattaaattgattgaagattaatgctttctagtacagactttatccttaattcttactatatgctctgaagcttcctgcttgaaggcacaagacaaatgggactgattgtgtctgtgtgtatgaaagtaacataaaaagtatataaactataaataaaaaatatctataaatgacatcattgtaatataaaacttttctaatactgttaattagtgtcatttttgcaagctgcttttctttttttgagacagggtctcactcagttgcccagcctggagtgcaatagtgcgatctcagctcactgcaacctccacctcctgagttcaagggatcctctcacctcagcctccaagtagctggtactacaggtgccaccacactcggataatttttgtactttcagtagagatgagatttcaccatgttgggcaggctagtctcgaactgctggcctcaagtgatctacctacctcagcctcccagagtgctgggattacaggcatgagccaccatgtctgtccgcaagcagcaatgttaatagtcatctataaaaatagttttaggttgtaacttttgattctttacattttatacatctctacatctatctgtaactgtcattggaagaaaatacagacttggcgagcttgaagggaatattggaaatgatctatttttggcaattttttggtccagatctagctggctactggggcttcttactcacttttttttttttttttaatctcacttttgttttggctgctcagctaaggtgaatatttagctatgagaaactgctaggtacttctgctgttaaaatttatatcttctttggcttgaatgtaaattatccagtatcacattatcaatatttctttcagaaatggagaccatcgtagtccataaaagcatccacatagataacttgaagaactgtacaaatatctaaacaaaccaaaattcattttagtgattggagtatttcagattgctgtgtttctatctgaaactttaaagaaatatttgaaaaacattaaaaataattgacaaaaacttagcctggcctttaatcacattatttagaaaatatatttactgggccaaaaatatcaggatttatagaaattacatatccaattttcttatttcaaagtggagctgaaccaaagactgactgactgactgattgattgatttttagagacggggtctcactatgttgcccaggctggtcttgaactcctgggctcaagcaatttgcccaccttggtctcccaaagtgctaggattatggatgtgatccactgtgcccaactgaaccaaagatttaaagagattctctgaatgtcatctagattcataactataatcaaaatcttataattgacacatgtttatcctacatttgttagtaattccaaatttctttcattttctattacaaatcattaaaatattcaaacacaggcattcattagggcaataatcactaacactgaatcccttgaacacataaaatttataatataaatcaataaacttggaaaatgcatacattgaaggtctaatttataaattcagagatgttatttatccaccattaataagaatcctactgatagtcttcaaataagtccagagtttgtggcagtgctacacatatttggctaattataatatccataacttttatctaattaatagctatacagaaaacgaaaaatctgtagtttttctaatcaacaaatgagcaacgtcttttatcataaaaatattgttgcgctgaagaaaaatgctaatagttaaaaacaacatttctgacatagtttagtagctctaatttgtataacaatttgatttttctctgatttatgaaaacaagcataatatgttaaccagttaattagccttctaaatgtcaacttaaaaatatttatttcatgcattgtttgtgccaaacattgggttagctactgagaaaacagcgacattctgtgatattctaagattgcctaatttttatctgcatcctttgttatcaatgatgattaatgaacaaattttgtctaaaagtcactattaaaccaatccttaacatctagtttaaaactccattttgaaggagctgagacccttagagagtttaattgcctgtttctgaagaataaattgctgttgggaaagcatcactttcacttaggtgggatggaaagtacggcagatggtaatcacccacgaagcgttcctgcacagacagcacgccaagctggtagacgggaacacagacatttcccagggtcatgaaatccacagcattgggcaagtcacattgctacggtgctaccacccaccaattattctgaaacttcaccaagtaaagaatgcctatgacacacagtattgccttcaaccttatgcacgtgtgaatgtccatgtgaacctgttgaagagagggagagaaagagaggcagagaaagagagagagagaggggagagggaaaattcaagcagttcatatgttaccagatggtgctgcacagttacaggctcttggtgtcccgaacaaataactggacttggcacacacacagaggaaagcaaagcggcaaaagtttattcagcacagtattccactctgggagagggagcgcagactgacctctgcgagatgaaaacagccccagctcgccgtattagattgcggtttttgcctttacttttagcggcaaaagccgcagttacttttgcaccaacctaatagttcagattcttttgtgtgtttttttatcttcttctcccaagtgtctgccttttgattgacaggtggattgcttagttactgaggcacttatgcccttgcgcaacgcctccatcccacaattttaattacattcatgatatgcagtccatatgtatacactttaagtagctgattaccatgtggggtcattttaaggatactttttctctctaatgagcatgcccatctctgaagagcttcacctgaaaggtttggtccagatctagccggtctttgggacttcttactcacttttttttttttttttttgagccggagtctccctctgtcgcccaggctggagtgcagtggcgtgatctcggctctctgcaagctccacctcctgggttcacgccattctcctgccgc[181 bp omitted]cctcactttttttttttaatctcacttttattttggctgctcaacttccgcttcatatcttgcttcttgctcacctgcccctttacctttcttctgctctcatgctctcactcattctgccctttattcaacctccaattcctctgctattctcttagtgacctttgtcacttgggaagtacttgcatgaatccagagacatccaaattaaagttgtaactttgcaggctgtggagtattcattaaggttctattgctactgtaaaacaaaaatgaaattctaaatccccaatcaactgaatagaccccgtcttctcttggccaaggggatctccccccaccacaaataatctgaaaaactagttcaggccatgactggaaggtgtcagacaggccttgttatacctgctccctttggagcttatatccaactgacctaaggctaaaacagagctcataagactgacaaaacagaccctctgtggcaataagataccaaattccaacctgactctggtatagcatcacatgacagattgtagaccctgaaggaaatcaaagtactttacaccaaaatagattttctttgagatattttgaagtggccctgcaaagccattgctcgtgggacaaatgtggattttttaggaaatctccttccctttcttttcctgatcctgagagatttaactaacaatctgacatttaagccctgtaaagagagacatttaccatctattctctctgaaccatgctacttagagacttcatctatgtaacaagaaccttggcttctgcaaccccctaaactcaagtatttctctccactgatttcaactctttaggcaaagcttaactctttcaaccaactgtcaatcaggaaacctttgaatccacctatgacctggaagcccctgcttggagatgccttgtctttcccagccgaactaatgtattcattacatgtattgatttatgcctttgcctgtaacttctgtcttcctaaaatgtataaaatgaacctgcaacccaagcacattgggcacatattctcaggacctcttgagactgtgtcactcatatttggttcagaataaacctcttcagtaatttacagagtttggctcttttttgtcaacactatgagcccagttaaaaaagaaaggcaaactgaaatttttacttaacattgattaatcagtaattaacaaggcagtatggtaaaacataagatatacaaagtaaagtaaaattgatagttattcaaaagaagctaaacataagatattaagatgagttaataacaatgtgcaaaaactatccagtattctaaacaattaaaaaaaaaagatatatatcaagaataatcaaagtatgggaaaggacaatttttaaattccacacataattaaacatgcaaaatatgctgagaaataagtaaatggtttttgatagagacatacaatgaaaagttgaccaatgaaagataagacattaaaaattaagtcaataaaaggtaaaataaacaaataggctgggtgccgtggctcacgtctgtgagcactttgggaggctgaggaaggtggatcactttagcccagaagttcaagaccagcctgggaaacagcaaaactctgtctctacaaaaaataaaatgaaaagaattagccagatgtggtggtgtgcacctgtaacccaagctactctggaggctgaggtgaaggatcacttaagcccaggaagtcgaagctgcaatgagccatgattgcactattgcactccagcttggtcgacagagcaagactttgtctcaaaaaacaagcaaaccaaaaaacccccaaaataaaagcaaataagcatgaaatgcacacacacaaaaatgacaacaagatcagttcttctcattaacattcacccaggagggcaactgggatgttttcgactaactcattctcagggttggaattttaagactacaccatgacttggagatatgttacaaaggaaatgaaacatttttcttatttctgcacttttcccactgctagaatcccactgctagaatgatattcataaccaccctcaagcaaaatagaagaatgggtagcagatatgtgtgtgtgtgtgtatgtgtgtgtgtgtgtgtgtgtgtgtgtataacatttgctctacctgataggtagaactgagtttctcatttgatttatttcattttcttcatctccctttgaaattttttctgtatagaattggtgttactttttaagtgaaattgcaaagaatggatatcattataatacaaatttttaaaaagttacatcattgtggaataaaaatggtatcttgctttgaaagtagaaaagcttatcaatgcccttttctgagtagaaattcagtataaaaaaatcacctcaacaaagagaagtcaattttttaattggaatgaggtggaactgaacgtactctgcaagagaggaaactgcttattctttgagcatctcccaagagacacgctgtctataaacatctcaagaaaatgaaggaactttatttttagtaactttgtacagaaaccttgctaggttctaccccttttttttttttttttttttttttttttgtgaaggagtctcactctgtcaccccggctggagtgcaatggcaagatcttggctcactgcaactccgcctcctggattcaagctattctcctgcctcagcctcccgagtagctgggattacaggtgcctgccaccacgtcccgctattttttttttgtatttttagtaaagacagggtttcaccatgt[134 bp omitted]ttgtagtagcaggggaaaaaactactaataaaaaccttttattgcatcctcccttatgtcagatattttccatagaacattaagtgcaaaattcagaaatacttttttgaatgtttgggtgtattatttttctattaaatttttgtatttaaggtagtttatgaatgattttaagttaataatttttgcataactttcacattgttacattcatgtcagttttgcaacaagtctttcttaagtaattattttgtgtttgtcaattattttctgaattctaatgatttcagttttattgttaacaccagcattgtgtacattgtggtaatgtaataaccttgtttcagtcacatcagtttctttgtttcaggcatatattttaattacacatcagttcaattagacatcaggctcccagggaagaattatgcattttacccacaatacgagtatgttctaatgtctaatttctgtctagctgtgcctggagaaagctaaaatattcatctcttttggttaaaattacataataggatgacttctgcaacacacggaagatttgatggcagtgtctaatttttaaattaagataatcttccattaaagataatatttaattatttttaagataatatttaagtaaggaaggctgtccattcctgttttcaagttaaaggaaatgagcactgctagactgagattgagtcatagctgagcattggcatttactggacccaatactgtgtggctgtataagcatgtttaaaacaaatccatctttcaagctaattttgggttctcatgcactctgttaaatcactattcaagagtttctgggccaggtgcaatggctgttgcctgtaatccgagcactttgggaggcagaggttggtggatcacttgaggccaggagattcagaccagattgggcagcatagtgagacactgtctctaacacacatacaagttcttggacattcgtttgaagaatatccttaacactgagaaatgcacactcttgcactcaatgaaattgatttatttccattcacatcatcctacataattatctaccttaagcgtccatgacaactgagtcttcatgcaaattaaaaattgaatttaaactcaattttaccccaggattccatttcctccctcttaatacctccaaagtctattggaatatagttcctgtcatcagtcaaattctgcctttcctcttttttacaaaggtaccaatttctaaaccagaaagttgtccacactacagcctatgcgttgtctaatctgttcataattatatataacaaacattttcttctcactgtgggcttctgactttgcatatctgacaggttaacaataccgtagtatgtccttacgtatcatacattgtctacctgaaattgtcattgatattggtttgctctctctaatccatctgtttcctaaggtcagacaataggtaccaagtagagaaaaaatagatttcactggcaactcgtgtgctaagcttccatcagagtcttatgcagttaattctgtaccatacatttaattctgaaagtctacaaagagtttcttaggtgagatggtgaaaagtttttattttgtagccctttcagtgtcctttttgttgcttttctcctgctcaaagtttggtgggtgttaccctcagtgtctacgttgttacagagggagtcactatgtttctcgctgtccgtcatgaaaatgagaggtgggaggttatgtctcactctgacttcctgtctgaccatgaggtttgcatgcactcagatgctgtgtctcatggcattgatggtgaaaattcccctttattttaccccatttatttgactatctgggttgaggcatctttagcattggcttggtgccttctttctgtgtttgacttccatgtagattcctacccccccccaataaaaatccgactctgatgttggtctgagatgctgaggcaattggatgtttcagatgtactgaatttttaaggtaaagctgctgccacataacagatacatcattccattcatgctggcatcttccttaaaaatacaatttactttatggcatctttttttttattgtatctttatctcgttactgaagaaagctgtgcttaacaaggggaaggtccctgcttcaagctatgtcttgagaaaaggtgaaatatatttaataactttctcgttttttagagacagggtctcactctgtagcccaacttggtgtgcagtggtgcaatcatagctcactgcagcctcgacctcttgggctcaagcaatcttccaacctcagtctcttgagtagctgggaccacaggcatgtgccaccctgccaggctaatttttaatattgttatttatagagatggggtcttcctatgtcacccaaggtggtctcaaacacctggcttcaagtgattctcccgccttagtttcccaaagtgctgggattacaggcataagccaacatgtccaactctgttcttgacattctaaatgtgtacatgttatgtctaattacaaatttttggtcacaagtcttttttagccgattatggtctcctaacgtgtccggaattggtggattcttggtctcgctgacttcaagaatgaagctacggaccgtcacggtgagtgtgttacagttcttaaagatggtgtgtccggagtttgttccttctgatgttcggacatgtccggagtttcttccttctggtgggttcgtggtctcgctgactgcaggagtgacgctgcagaccttcgaggtgagtggtacagttcataaagatggcgcgtctggagttgttcgttcctccccgtgggttcgtggtcttgctgacttcaggagtggagctgcagacctccacggtgagtgttacagctcataaaggcagtgcagacccaaagagtgacagaccatcgcggtgagtgttacagttcctaaaggtggcgcgtcctgagttcattcctcaagtccggagttgttcgttcctcaagtccggagttgttcatccctcccaggggggttcgtggtctcgctggcttcagaagtgaagctgcagaccttcgtcgttaagtgttacagctcataaaggcagcgcggacccaaagagtaagcagcagcaagttttattgtgaagaggaaagaacaaaacccccatagagtggaaggggacctgagcacattgctgctgctagctcgggtggcctgcttttattcccttatttggccccacccacattctgctgattggtccattttacagagagctgattggtctgttttacagagagctgattggtccattttgacagagtgctgattggtgcatttacaaacctttagctagacagaaaagttctccaagtccccactcgccctagaagtccagccagcttcacatctcactaatgtgggatatatttatttcttcagcttcacaaaattttcctctactattaggaattttgcatacagcctactctttattctcttgtcatgaaattcattttaacttaatttcataatgaatggattcagccttaatgttgcttggcttttttttttctttcttttttcatgatcattcttggtttgaaattcctattctcatatttgttcttcacccatatctaaattgctattcatgccatccattgatttttacatgtcaatgatgaaaaattaattttcttcctctccttctgatgtgatattctccagcatatggcagacaatgtctttgaagatattcagtgtagtttatttaaaacgttgttctgttttctctgagtttctttgactttgtcattctctgaacgtaagttcaggggatcttgttgacagcaccgtatttgtccattgttggtaatttattaaaggtttggtttgctttatgtttaagatttgctgaattctgtctgcgagtggcatacacatctgtttatggcagtgttttctctgtgagtgtgataagttgtagaacatgcttctgggaagatgtatagcatatgagagtggtgaagacaaaataaatgtctgttgccctttgagaacattttctgcttgtggagtttcttcagtactctatgttgacaagccatgtgttaagacaatggagaaagaatcatacaccaaacaaatttatatagtgatagcctcacaaaaactgataccttttaaatgagataaagtgagtgattagaacatagaattttgtaatttccaaaaggatttttaaaaaaatttaaataaaaaatgtaatattatgtcaattgattatgatttctgaaactaggtaaaaaaaagaaacaatcatttctaccaaatcaggtatctaaaaaggtctggaaaatctatatttggtatgcaagaaaaaaattcttaaaagagaattaaaatcattttatgtgggtttgtgtaggttttcctaaataattttagggcaataaactgtccatcttactgccaacagtgcatgtaaattataaaaaatagactaagcataatatcaagaaagaaaccattgtaatgtacatggacacgtacaactcataattgtactcattggaaattatgccagagagatcaaaacaacattcaaataaaaacctgtactcaaatgttcatggcaactttatttagaagagcaaactctagccaggcacagtggctcatacctgtaatcacggcactttgggaggccaaggcagaaggatcgcctgagcccaggactttgagaccagcctgggcaacatggcaaaatcctgtatttacaaaaaaaaaaaatacaaaaaattagcctggtttggtggcatgtgcctgtgttcccagctactcaggaggctgaggtaggaggattatttgagcctgggaggtcgaggctgccgtgaaccatgcttgcacaaactgcactccagcctggtcgacagagcgacgctgcctttaaaaaataaattaattaaaaagattaaaatcctaggaagaagctaaaagtcattgaatgagtgaatggttgaataaactgtggtatctccataccgtggtatatgagtgaacgatagaaaagaataaactattgacgcacacaacaacctaagtagacctaaaggcattatgctgagtgaaaaaaagtacatatcaaaaggtcatacactgcatgatctcatttacaaaatgtcctcaaaatgacaaaatgacagagatagagaagagatgagtggttgtcaggaaaattgcatgggtgcagcaggtgctaacagaagcaccaggagaggcatcttttgtgacgatggaacaatttttaatcttgattgtttagtagtcatgcgaatctacacatgggataaaatgacatagaattacacacacaaggacaaaaacacgttattgtgggattataaaagtagtaaaaactaaacaaggtctgtagtctccttaccaggattgtaccaatgccaatttcctggtttttatagcatactacagctgtgtgagatgtcaccattgcacatggatggagcgaagcattatatgggactctgtgctatttttgcaacttcctctgagaccattttaaaataaaaaaaagtaaaagaaaaaactcataagtatcctaataacaaagaaacaaaatatagacaccccaccttcaacacacatcacattttaaaatccaatagtctgagttatgacttggttttgatttttttttttggaggggggctttcaaaacaaatcatgtaccagttattttcccaacaggaaaatatcttttccctaatatatccatgggtttctctcatatttaattgtagactctgctgctgaaaattcacattctcatagaaaccctctgtccatcctataataaaatggaatcaccctaaaatctctataccaggggtctccaactgttactacaaatggtcagataatagatattttaggctttgtgagtcagtggtttcagccacatatgcttaactctgctgttttagtgggaaagcattcatatgctgtatataagtgaatgagtgtggcagtgttccaataaaactttatttacaaaaatgggtggagagcaacacctggcccatgggctgtagtttccagacattctttgctatagttataattgttttgttatagggcctacaactatgaggacttgataccatatcatatgagtttgtttattgcctctctccctacatgatttccaactccataagagtgtgttgctatattcccagcactttgctggttcaccatacaaagtaggcacaaaacaaacacttgttaaatgcattcttggattcctgactcaataattgaaattcaaaagtccaagaaggccaggcgcagtggctcacacctgtaatcctaacactttgggaggcctatgcaggcagatcacttgaagtcaggagtttgagaccagcctggccaacatggcaaaaccctgtcactaataaaaatacaaaaaaaaattagttgggtatggtggcaggtgcctatagtcccagctactcgggaagctgaggtgggagaatcgcttgaacctgggaggcagaggttgcagtgagcggagatcgcatcactgcactccaacctgggtgacagagcaagactctgtcaaaacaaaacaaacaaacaaaaaaatcgaaagtctaagaaatagccagaaaacatcaatgctattgaaatttgatttaacgtttatgatacaggtgctttgaagataaaacatcaacaccaaaacaagatcattgttttcaggctataactttttataaggatttagaatcatccaataaaatacaacttattaaatatgtttcactctccgatagaaatattacaattgttgattttccaaaattactcgaaagcgttttggtaaactgttcatattttcagaatatcttcccaaaaaaataatcaaaagattttaggaatagttaactctaatgccgcttggtttacatgacattctcctaggaacttaggtggtgatgaagggaataaattttagaatgaactacaatttttattattcacttagtctctaatgcagtgaatagagtgacattaaacactcactcccaagacaaaacaattaccttttaagactacattccaaatactagatgcagaaattatcagaaatacacccgtggcaaagtggcaatgttcttgccattctaaatagtttactgaaaactcagctcagacaataaaacaactgacttactgcaaagataaatgcaataaaattgagttgaattaatatttaaattatactcagaagggaaaataaggctacgttagaaaaagtataggttgcacagaggacaatttccggttttaaaaaagtgtaatttataacctgtatcaaattgtttttacggcattttttaaagttcaaggttacaagtgagttgctatgcaaacagtcctaattctctgtcttttcagcacatgccatgttgctgatcattcagtgaaatattcaaaataaaggtttttcttttgaaatgtaattaatcagactacctaaatattattaggcagaccatctataattaggcagaccatctaacacactgggacatgtttgtggtggaaggggaaagtcgtaaatatgtgacacatgtgcgataatccatggatttcctaagcaaaaataactggtggccaccctaagtaaaaccaatgtgtcatttcaaaagatgccgaaaataaaaataaccttgtgctgccatcaaataaggccatccacttaatagccagaaataaaaatcttttcaaaagatcttcatcctattgctcagagttaataaaattattaattcattgataaatgtagtcagcaaaaaaattaaattggttgcctttttttttttttttttcaagacaaggttttgctctgtcacccaggctggagtgcaatggtgcaatctcggctcactgaaacctccacttactgggttcaagtgattctcctgcctcagcctcctgagtagctgggattacaggtgcccaccaacatgcccagctaattttttttgtatttttcgtagagacagggtttcaccatgttggccaggctggtctcgtactcctgacctcaagtgatccaccagcctcggcctcccaaagtgctggaattacactagactttgattatcttttaagttccagtactgccaagcactggccattctttcaatgaatgctcataatgtgtcatttaagtcagctgtcctatgtcatctgagagaccaaagagagatgcctttttatcaacaaagagggatcctaaaattaaggaaacaaaagttacctatgtgtgaagggttcaggctctggttggcaaggcaaatttctaaattcccatggctcaactccctaagataagagctatcaggcaaattacccaaccccttctaactctgattttcaatccagatcactacaactctgactggacagaggactggccccacaaaccttcttttctgctaagcaacttcagaccttaccatcagtttcagcagcttacagaggctgtacacaaattgtctttgtgtcctattgtccactttttgacataaagagcttaattctaccttatcgccatcataaccgtcatcatcattatcaacatccccatcatcattgtcatcatcatcatcaccaccaccaccattttaaatgctaaaacttcacaccaaagtgaacatgggatgtatgttacatatatgtctacccaatctgcatgagcttggctcctctcataaatatggatagctttcctcccaaggctgctgaatatgtgcgactctattgtgtaatatggaccctgtgaggcataaaacccaacctgcccttcccctcttcaaaaagagagtatcttcagtccaccccagaaactatctcttcccagttcgcaaaccaattatcaccaataaagctcttctttcgactgtttagccatcctggtgtcttttgaatgccatgtaggaatctttttttttttttttcctttgagacacggtcttgctctgttgtccaggcctgagtgcagtgaagttatcacagctcactgcaaccttgacctcctgggctcaagcaatcctcctacctcagcctcctaagtagctgggaccatagtcacatgccaccacacctggctaatatatatatataatatgtgtatatatatatatgtgtatatatatatgtgtatatatatgtgtgtatatatatatgtgtatatatgtgtgtatatatatgtgtatatatatgtgtgtatatatatatgtgtatacacacacacacacacacacacatatatatatacacatacaatatattgtagagatggggtctcactatgttgcccaagctggtctcaaacttctgggcctaagtgatcctcccacttcagcctcccaaactgctggtattacagacatgagccacatgtctggtctgtaggagctttcgaagggacaaaggtcgagcccaaacatatttagggaggaaaattaaatgaatcgtgcatgagccctcgttttttgtttgggatactaacgtgttggaaatcatcatcccttaagaaatataggaggaagaatattatggaatttggataaatcataagtcttcctcttataattttggaatcctttagctaatcttagattcattttggataagcatattaagtatatttatgtgatatccaaatgtgtatgtgtgagagattacagttacatttactaaagacattttaatatcatggcctggcatagtagctcaggcatataatcccagcactttgggaggctgaggcaggcggatcacttgaggtcaggaatttgagaccagcctgaccaacatggtgaaacccgtttctactaaaaatacaaaagttagccaggcgtggttagtgtgcacctgtaatcccagctactcaggaggctgaagcaggagaatcacttgaacctgggaggcagaggttgtcgtgagcagagatcacaccaccacattccaacctgggcaacagaacaagactctgtctcaaaaaaaaatttaataagtttatatgtattaaatatatttatttactatattaatacatttaatataaatatatttattttatatttattcatatcaatatataatatattaatataaatcaatatataatttatattatatattaatataatatatattataatatataattatatataatataatatattatataattatatattataatatattaatataatatattatataatattgataatataacaaatatattaatatataatattaatataaataaaatattgaatgtaatatattaaataaatatatgtaatatatttatcaagttgtattagggtccagaacttagcatagaattctggtctagtgattgatttgcaatgactgagtagaggtgattgcagacaagcatttggatcaaagaacccaatgtattggttctgtagccttcaaagggtggataattgtcttgagaatcattatcttccttcttttttgtgacttttgattagcgtgcatgtcgaaggagtgaggtggggttagaaagctttcataaagactaaggacacacatcttacctttatcttatattttaaggcatatcccaagcaactattcaacatgttcaagttttactctccaataaatatacttggtattaaagaaaggtaaaaacagatttcttctggcacttttcagaagcctccatgacatggtgtccagctccctgaatctatgcctatgatatgcctttagggaacaggccaatactccctcctcttggctacccaaaaaatgactccagtgtacatttctgcctatttttttcaagacacaaactcattaaaggggcatggtgttctgttcctcttcttccctttcaaagcagagatctgatattcagggtagttttccaagttacaacttgaaagaaaatgttcctcaactctgccaaatcacttatttcaccattcttggtttatgaatcaaattgtcattaattaatgaacaccaacaccaccccatgaacccctttcagatagagtaggagtgtatttaattgaaggtcagtaacttggccaaacaagagtgccatctaagctgaacagagccagccattctggtttcccttgaggtatcttttatgagctatactacagtcagtcatctggatccttgctatctcttagaaatcccccgagaatggttgggcatggtggctcacgtctgtaatcccagcactttgggaggcagaggcaggtggatcacttgaggtcagaagtttgagacccctggacaacaagggaaaatgccatctctactaaaaatacaaaaattagccaggcatagtggtgcacacctgtggtcccagctatttgggagactgaggcatgagaatcacttgaacctgggaggcagaggtttcagtgagctgagatcacaccactgcactccagcctgggcaacagagcaagactccatattagtctgttctcatgctggtaataaagatatacctgagactataaagatatacctgagactgggtaatttataaaggaaagaggtttaatggactcacagttccatgtgtctgggtaggcctcacaatcatggtggaaggcaaggaggagcaaaggcatgttttacatggtggcaggcaagagagcttgtgcagggaaactcccacttataaatccatcaggtctcatgagactcattcactaccatgagaacagtatgggggaaaccacccccatgatttaattatctccacctggccccgctcttgacacatggggatttacaattcaaggtgagatttgggtgggcacacagacaaaccatatcacctggatttgtctctgctcaaataaaagccaggaatgtgtgtgtgtgtgtgtgtgtgtgtgtgtgtgtgtgtgtgtgtgtgtattttcataaatgggtatttaatatgtatatatatgtttaatatatatgtaaatgtgttttaaatatatatttttaaataaatgagtttttaattcaaaaaaatataaacattacaaatgacattgttgatctatttgatctgagatgggggctcctttgctagagtagtttccttccattcgttgtcaaaacattaccttcataaggcaccatgacttattctcgagtactaactaaaattgttcatagctttgtaaacaacaaagccacaggcagaataggtatggtcaccaagcccacaaggttcttagatctcatagctaccgaactttaggaaaatcctcatgggagttacttcagccagtttcaactccttaacaggtgacacatcacctacatctgaaaagagcagtctgccaagggagttaagcaaagataaggaaagtttataataaatggctcaatttattctacagggaagaccttaaaaatataatgcaaaatctgattttgtcctggatgtgtttgtaagttggacatgacatttctacataagtaggaaagaaaaaatacctcaatttctttattatttcacacatttcaataacatattctatctgattaaatccttacaacgatgagaagattttataatcttataattacaatcactatcactaccactacaactaccatattatgactatcatcactatcattgtcttcatcatcaccaccatcatcaccatcaccattatcatcatcaccatcatcatcaccatcaccaccatcattatcaacatcaccatcatcatcatcatccacatcatcactatcatccaacaccaccatcatccatcaccatcatcctcatcaccaccatcattattattatcatcaccaccatcaatacaatcatcatcattaccatcatcaccactatcatcatcatcatctttgccatcattatcataatcatcaccaccatcacatcactattatcatcaccatcatcatcaccattatcaccatcatcatcatcatcccaataattatcagcatcatcagcatcatccccatcactatcatcatcaccatcgccatcatccccacttacatcaccatcgttatcatcatcaccatcaccatcactatcatcattgctatcatcaacactatcatcatcatccctcacaatgtcttgcatgacgatccagagatttccttcatattaagagacacaatgtctgtagtcagcagaataatggccctccaaaggtggctctcatgaaacctgtgaatatttgactttatctggcaaacaggacattgtaaatgtgattaaggactttgagatggggtgtttcatccagatagaccaaatgtcattacatgagtttttcaaggtgaaaatatgcagttaaggaggactcctagttatatgacctgagaaggatgaatgcaccattaatggattttaggaggaagaggggaccacttgcccagaaaggttggcaggctctagaatctggggataacttaactgacagctggcaagaaaattgggtgttaatctgccaacaacttgaattaacttaaaaacaaattctttgcaagagcttctggaaaagaacacagcctcccaagacattgatttttgcccagagaaacttgtgttggatttctaatctagagaactgccagattctaaatggatcaccttttgagcaactaaattagtggcgattttttacagcagcaatagggaaaatgcaatagcctggaaggagaacacttaagtatgaaagtattaaaaatattctacgtagctggggaaaaattcagttagacatggtagggaaaagataggtagtctgtatttaattgaaaggtactaatgaacaaagacaataaattaaataaagaggtacactcttaattgaacacttgttggtgtagcatcctgtcaggatgctgaaaaaaggaagaggtactggtatcctagtggtcagtccctagcttgtagctctgagcctgatttcaagaattctccaggacactgagaagaactaaagaaaacgcaacacgttattttgggtaaaaacccacaaaaaagtgaaacattttgttcaacaatgagaaaataatttaaaaattcagaaacattttcttcaaagacaaaaaagtaattaaaatgaaaacaaaagtattggaaagattttatggtggtgacaagggatggatgaaatattaataaaaacagtgcagtggtgatgatttgtgaaacaggcaatatgtgcttggggaataatttattactggatggtactgctggtggcttcattcttcaactcctctagttacacactgggatttttattgtatataaatttatatatacaataaagcaaagagttgataaatgattaggagcttattttcaatatgacaccatagacataacaagttggcaattttcaccttccaaccatctacttgcaacatacgtaacagagagttgatacagatgcaatagacacacagagagaaacatccatttttttatagcaaatacacatttccatagaaaattacgcaaaatacatgatttttttcagagaatacagaatcatgaataaataaaatttgcaattagaaaattacaaattaaaataattttaattatacatgtcagtttgtcaaatattaatatcacagaaccctggaagttggtaaacttatggggagtaggcactcctcaattacctttgatggagtttgaatttttataataataataataataataataataataaaaaccttggctgggtgtcagggctcatgactgtattcccagcactttgggaggccaaagcaggaggattgcttgaggccaaggagtttgagaccagcctggccaacatggcgaaaacccatctctactaaaaacacaaaaattttcagtagagtgtgtgtggtgatgggtgcctgtactcccaactactcaggtggctgaggcaggagaattgtttgaaccccgggagatggaggttgcagtatgccaagatcatgccattacactccagcctgggcaacagagcaagacaccacctcaaaaaaaaaaaaaaaaaaaaaaaaaagaaaatgcttaaaatcactagttattaagaatgcgaattaaatccacaataaaatgcaaatatcacttctgtgagctatttttaaaagttcccagaagttggttatatggctggtaggaagactgaaaggtgagtggataattgaaatgccaaatgttgagtttcctctccaagggagcccaaactcttgagagcatggtgctgtgtgtcattgttctattttgctgccaccacctaaggcgtgaggcctttgctcatgctcatctatttcctaaatcgttgtagggaccggctgccgaggagatgggtaagaagctgagaaattgttttagtcacatttacttacagatgagcctcggaattaatcatcttgagctgtccatagcttcttttacattatgtatatattgtatatatgtatgcttttttttgagacagagtcttgctctgccacccaggctggagtgcagtggtggaatcatagctcaccacagcctccaacttgcaggctcaagcaatcatcctgcctcagtctttcaagtagctgggattacaggcacgcaccaccatgcccatctaatgtcttttttcttttttctttttttttttttgtggaggcagagtctccatatgttgcccagctggtgtcaaacttttgggctcaaacaatcctccctcctcagcctcccaaaccactgggatgacaggcctgagctactgcacccaggccatagcatcttcatgttccgttttgttttttcctctgcaagctgtgccagagttgcttggtctcagtatttcaattaaacaggaaataaacatcctcccttagatctctcatagaagccacttacttccagtctgctttataccagagctccacattgcctactgcgtggtgaagcatgcactacgtggtgaagcatgcatgcgtggtgcaaagcctcttgggtttgaagggctgaaaggcaggatgtgcacctctttgggagcaggtggaaggttgcattcattctgctgcacagcttcacgattttccccttatgccttgcaactggaatatagtagagactcaataaatatttgacgaaagaatgaatgaaagccaaatttagatgaaagcctgtgcatttctaatgacatctgtccttatgggatacaattttatccagctgctctgaattgctggagcaaaggaggctgtaggcaagaaacttttataacaacttggcagcaagaacacgtaccaaccccaacaacaaaatatatgttatctgtaatatgttctggacttccctccctaaatataggtttagtccacatgaaaaatgagtacaaaattgttacacttagcactttctatatctacagcaggagagggtaaagctggtcgtgtcatggattaaaagataaatatatgaaaacttgttttttatcttctgcatgacagcaagttgcaaatatgtggacacacagttacatgtgcgcacacacacacacacacacacacacacacacacacacacacaggctccgtacttcagggaagaaggcaacaggtagttacagcaaaatgaaaatatatctttattttattttattttttgagaagagtctcactctgttgcccaggctggagtacagtggcacaatctcagctcactgcaacctccgcctcccgggttcaagtgattctcctgcctcagcttctggagtagctgggattacaagcgcccgccaccacgcccggctaattttttaaatttatagtagagatgggatttcaccatattgaccgggctggtctcgaactcctgacctcaattgatctgcatgccttagcctcccaaagtgctgggattacaggcatgagccactatgcccagcctaaaatgtatctttagaaatacagggattgacacactcactgggataagcacaattttaaaaaatagaaaataacaagtgttggccaggttgtggggaaattgaaagccttgtttgttttgtttgtttgttttgtttacttttttattattattctttaagttctagggtacatgtgcacaacgtgcaggtttgttacatatgtatacatgtgccatgttggtgtgctgcacccattaactcatcatctgccttaggtatatctcctaatgctatccctcccccctccccccaccccacgataggcccctgtgtgtgatgttccccttcctgtgtccaagtgttctcattgtttaattcccacctatgagtgagaacatgcggtgtttggttttttgtccttgcgatagtttgctgagaatgatggtttccatcttcatccatgtccctacaaaggacatgaactcatcctattttatggctgcatagtattccacggtgtatatgtgccacattttcttaatccaatctatcattgatggacatttgggtcggttccaagtctttgctattgtgaatagtgccgcaataaacatacgtgtgcatgtactattggtgggattgtaaaatggtaaagctgctgtgaaaaacaacatgatggtccctaaaaaatataaaaacagaactaccctatgattctgcaacagcacttctgggtaaatatccaaaataattgaaagcaaggtctccaagagatatttgttcccatgttcatagcagcattattcatagcagtgaaagggtggaagcaaactaagtgtccattgtgaatgaatggataaacaaagtatagcatatacatacaagggttattattcagccatagaaggaaggaaatcctaacacaggctacaacatggaggaaccttgaggccattatcctcagtgaaataagccaggcacaaaatgacaaatactgtttaattcaacttttgtgagatcgcaagagtagtcaaattcatagagacagaaagaagaattgttcctggaccaaactgagggtcgggctgcttattcttgtggcccagtaatgagatgcagatgaactgggtaggaggagagtttttatttctgtaaccggttacagggagaaggcctggaaattatcgccagaccaactcaaagttacaaagttttccagagcttctataccttctaatcaatatgtctacatgtaagtgtgcattcatctaaagacataagtgatgaacttctaatctagaactaaggtctgagtcctggagaccttcctctggagtctcagtaaattgacttaatccaaatggatccaggtgcctggggtgattacccttatcttgtctcccgctaaattgtggaagtttggggagttcctttagacccagataaagcttgtttgtggaggtctggggagttccttcagaccctcagtaaaacttgtttaatcctaaacaggtcgtgttaagaatcccttcattatcttgtcatgcttcaaggcccaggagaggcctgggcagaactcttggtggacttttgttacattccagcctttgtataagggtgctggctctttcagcttttaatatttaacttcaacactctgtcagtgctgaaacagttgttacggaggcctgtgtttgtgagacctggcctgccacagaatggtggttgccaggggctggggaagggagaaatagtgagtgagtgtttaatggggacagagctttagtttgggtagaagaaactattctgaggatgaatcgtcatgacgctgccacaacatgaataacatatttaatatcacttaactgtacactaacaaatgaatgcgatggtatgttatgtgtatgttcttatcatatacatttggaaaaaatttatagtacagaccttcacaataacaggtcatggaaagtcagccctaaaataaattactttgtaaagtaaatttttaaattaaaattaatttttaatttaaaatttttaattaaaaaatgaaagggctgaatatatgatactgaaaacatgtgttttcaccaaagtctgattttgctcagcataagaattaaaagtataaaaatatataagtatcaaagtatgtaagtataaaagtgtacttattatagtatactttgcaataagcatatcatctctaaaacaggagggtaaccaacctactataaaaacaaaacaaatccagaaacaacagctacagcaacaatagtgtgcaaaatagaagaggcagaacaaagattataaaggaatttctatttgttcagaagcagctttggaaaaaagattgccaattttatggtgggggaaatcgggttgaagaatataagtgaccacttgatttgtgaacatttgtagggacatatatgggctgccagttgttatgagtgtgtttatttatgatcgctggtcacctcgtttcatcgtatctttgttcatgtttgcatttagagcttggcttctcacagctctgttatgtctctatacctaacacaggagaggcgatgtgatcagtgctgttatgattctgtgccaaggagtgccgtctgaacagagccttcccatgtagggatatgacacaagtcagtctagttccactcctttttcattgagaagagttacatttaattagtggttgtttctttttttttttttttttttttttgagatggaattttgctcttgtcacccaggctggagtacaatcgtgcgatctcatctcactgcagcctccgcctcccgggttcaagcgattctcctgcctcagcctccctagaggctgggattataggcacctgccaccatgcccagctaattttttgtatttttagtagagacagggtttcattgtg[137 bp omitted]ttcttttggtgataatccttcacacttaacctactgagaagaaagactttaaagttctgaaaagcgatgtcaatgtagtgcagctgggaggagcacaggcactggcctccacattctgactccactctaacaatcctatacttctgtgaactctatacggattaagctacatacagtaatagtgcccacttccagcagagatcatggcaattaaagggaaacatgcatgcaaagtgtgtcccaaagagcccaccatgaaggaagaacacatccacaccgtagctgcttcacctttctgaacaggtcatgtgatatttcatgtagatgtgcaaacacttgaatattttttctcgtactttcaaagtatcttcagttgacaatgaggtaattctagtgtaactatgtgtgtgtgtgtgtgtgtgtgtgtgtgtgtctatatcagcattgtaaacacatggacaactattagtgataatgctgcagataattatttttcagtcttacaaaatatacagaatatcaactatcaattccacatcttctctactttccaagccttcttcatctcatttcaatctaatcccctcctaaagggcaaccaacaacatagatttggtgtggattcttcccattcaggtattacggttttataacaaagctgtatatccccaagtgatgcagaccttaaaaactttatataaactatatactatgggtatggggcggttttgcaactttttactcaatgtattttacatctatcagtgttactatagtatatattgtccattatttcaactgctggattttattgcgttgcattgcacattctgctctgggtgaaaattttgattgcttttactctttataatatatcaacacagttgtcatgaatgaacctcatcttatttatccacttggcacaccatgagtaagactgcctttaggttacatgcctagaaccaaaattgcagactgttatgatgtatgttatccattttcaatgttagaggaggcgtgcatgttttaaataattttcacttccattggcaggttgtaagtgatccccttgatgttaacaatttttggtgctattaccacagaggtcatactttgtccttctcaggtcatctcattgctacaattttaacccttggttacttgattaagttccttattgggtttcttctctttgttaagtatacataattagacagtgttaatctcttctttccactaagtactataacactctgtaaattgagatttatagaatcatgggcaaatgtctcttcctttcatttcattttatagcaatcatcattcttcacagtaaaaattgttgtgatgtatctccacgcagaaatgagagaaatgtattaagtctcagagcacttcaaagataggaatggctagttcttacctataatgttttctgacttcagcaaagtcaccacaacatgagcaaatgaaaaatgtgaagaaattccactgaacactctgtgaccttggttagcacatgctcctcttaattttgtgctttaattcactatccaaacatctctatttgtgatgtttctttccaatatagctgttaaaaacaaaagcaaatgcaaaggttttcttactttaattatttgttatatctgctcttttttctgtgcctttagtacatattattcctttgtttgatatcttaaggtgatataattactatttttgttatttttacttttaaggagaaaataaaatacttaattacatacccatttttttcctacttacaggaccttgtcaaagattcctgcttgagcaactgtttctttttaatgaagtaatgtgatctttatcaaaaacgcttgaaaacacgtccactaaaattcctgctcttggtggacgttggagatgtgtaaagagtccagtgtttaggaacttaactctgaccaggataaagtgaatgttggagagtgaatacaaatgagagttagatagaagtttatttaaaaaaaaatcctaacaaaatagagcatcattactagaatgtatccaatcttaaaatatttaccagcataattaaacgtatgcactcattattatgtgacatattgtgcaatagggaattgaaggctctgagttagagtaaggtcacaaggaagccagtttatttgcaaatgggaatttgagagtgtgaccctataactaaggaaggaatggggctggtggagtgaagagcaaagacagatgagcaaattcaacttcttagaggccctatttctgccctcctagcctgtcatgcctttaaaatagcatgtctatttagatttgccctttcctgttttctacgcctatttaatagaggaggtcggggaatcttctaaactgcttatcacctgggaattagctcggatgtctgataccttcaggccatgaatatataattaaatcagtgcacttttacactgctggtgggaaagtaaactagtacagccactatggaaaacagtgtggagattccttaaagaactaaaaggcgaactaccatttgattcagtaatcccactcctgggtatctacccagaggaaaagaaggcattatatgaaaaagaaacttgcacattcatgtttatagcagcacagttcacaatagcaaaaatataaaaacagcccaaatgcccatcatagaaagaaaatttggtatgtatatatacatacgcacacacacacatatatatatataatatatgccatggataaagaaaatgtagtgtatatgtataccatggaatactactcagccataaaaaggaatgaaataatggcatttgcagaaacctggatggaactggagaccattattctaagtgaagttactcaggaatggaaaacgaaataccatatgttctcacaagtgggagctaagctataaggatgcaaagacgtaagaatgacacaatgggccaggcacagtggcttacacctgtaatcccaccattttgggaggcctcggcgggtggatcacctcaggtcaggagttcgagaccagcctgcccaacatggtgaaaccccgtctttactaaaaagtacaaaaattagctgggcatggtggcaggtgcctgcaatcccagctactcgggaggctgaggcaggagaatcgcttgaacccggtaggccgaggttgcagtgagctgagattgtgccattgcactccagcctgggtgacagagcaagactccgtctcaaaaaaaaaaaaaaaaaaaaaaaaaagaaatgacacagtgaactctggggactcgggggaagggtgggaggggggtgagggattaaaaaaatacacattgggttcagtgtacactgttccgtttacgggtgcactgaaacctcagaaatcactactcaagaacttatccatgtaaccaaacaccacctgtttccctaaaactattgaaataataattaaaaaaaatagtgccattgaacagggacaatgccacgaggctgtgaatcatataataaccaagtttcagaaatccatgtgtctctctaatactcatgccgtgactaaattgggagagaagagagggaatcatagactccagaaataattgcttcattgcctctttaaaggactgtacatggctgatgctcaaacagcttattcaatatctcaaacatctctctaagtctgcaacatatcaagcgtgactacttagccatacagtcggctcagaaaacaaatccctgccttcttaatctaaaaccaattgcaaataatggcccttcatttctgttcttccttgaagctcttctccctattaagtaaccttaattgctcccttttactctcgttatctgtgctaaattgaggtttctattgcagaagttagagacttttacttgcacggatctaagtacaatcacaggctgtgaaaatcttcaaagcaggaaacttggtttactcatttgtcttaattcagtacaagccaaggattctttccagtcatatgaactctattgttgttcgaattagcattattagcaattattttcaactaacatatcactgttagaatagtccttaattgtaagaagaaaatgacccagttagcagtaacatttagaaaagcaccatttcaacataattcaccttctgggcattggtaactctactctggcagacaatcactcccatagcactcttctgttcttttatttttgtggtcaaagtgacaatagcattcatattatcccatgttatttttgcaccataaaaatttaattcagaattaaagagaacataatctctatatggaataatatttttatgggcaacttaggggaaaaaagtcttatgcatacatgcacatgtacatatataaatatatgttcatgtatagatccacgtacatgtatatatgcatgtatatatctatacataggaatcacaaaatcaccttttaaaaaatataaacatgaattgattctctggagaaactcctgcttccaaatctttttctctattctgccaatgcaaataaccaaatacaatccaagctgtcctcttctttttattatttttatttttatttcaataggtttttggggaacagatggtgtttggttacataaataagttctttagtggtgatttctgagattttggtgcccccgtcacctgagcagtgtacactgtacccgatgtttattcttttatccctcaccccatcccaccctttcccccaagtccctgaagtccattattttattcttatgcctttgcgttctcatagcgtagctcccaattatgagtgagaacatacatgtttgattttccattcctgagttacttcactaagaaaaatggtccccagttccatccaggttgctgcagatgccattatttcattcctttttatggctgagtagtattccatgaaatatacatatcacattttctttatccacttgttgattgatgggcatttgggctggttccatatatttgcaattacgaattgtgctgctataaatatgtgtgtgcgagtatcttttccatataatgacttcttttcctttgggtagatacccaggagagggattactggattaaatggtagatacccaggagtgggattactggattaaatggtagatctacttttagtgatttaaggaaactccacactgtttcccacagtgattgtagtagttgacattcctaccaactataaaagtgttcccttttcaccacgtccatgccaacatctattattttttgattttttgattatggccattcttgcaggagtgaggtagtatcagattgtggttttggtttgcatttccctgatcattagtgatgttgcaagttctcctcttcttcatgcagggcatatatttaaatgtcttctttcattttctttaacacatttttactttctttttagcaaggttgcatcaaatatagccctctacttttaaggggaaaaaatgacctgcaattgtgaaaaatctcaacctctataaaagctaaacatttgaacatatatttcaaagttttttttttaatcttggaacatatgactaagacaaaccacattaacacattaaatccaattcctccctgaattccaaaaagcaattcttacattcttatattctgtatattccatcacttttttttgctggagtgagatgcaggaattcaaggagaatcaaatgcaaagagggtgattcaaagggacatgatgaataagatgcagtgatagcaatcatagatttctgaaactagaagaaacaatcatagtcattttatttctccttattctaatggataagtagtttatttacaaacagaagcattctgctttgatagtaaagagtcatgccagggttgatgagaggctgaactggaaaatgagaaaaaacaacttgtgggtgactcaaagccttcatagttttaaaaaatcattgtgtgtaaactaaactaaggatgcgtgcccaggagacaggtctacgcctttctctggagatgattttgagggctccatatttaaaagggaaagggcgggttattgagaagtacacaattttcatatatggcggggtagggaaaaatagtcattcatgcctttggtctggtgaatctacatttatttatttatttttttttacataagatgacatagacaaatggaacacagcaaaaaatgcaaggaatctgcatgttacataagataacatagacaaaatgtgacaggggagcaatcagatatgcatttgtgtctggtgggccaggggtgactttacctgtaaagataagctatcattgccatggtgaaatcttcacagaaacaccttaggataaagatcttgcagctcactaggaatatccttgtgggcaaaatacgggggaggcatgtggcttttcatcctgtagccatcttatttaagaaccaaaaggggaggcaggtttgcatgacccagttcccagcttgacttttccctttagcttagtgatttggggaccctaggatttattttcctttcacattacctttctcagaagccagatttcagataaaaacatacctaatcgtccctgaatttaaaatcagaatatgaaaagtgtctatcaaagttcaattttagggggacaacatgcattattcaaactggcagtcgttctgcacaagtatctgtacctacatctatatctatatctataatctatatctgggccagaatattattaacacataggaaatgcaaaacacggtagcagaagatagaattataacagtaaactaagctaacccaccctcccattttgccttttccttaattattcctggactcttgggcctagctaactttgaaagacatttaggctatagtttaaatgataacagccttgccccgaaattcaactgtttttgtaaagctaatggggggccatcaggctggggtgaggagaggcaccccagagtccggctaagggacagacataaacgacttattgctagccaatattccagaggttataagatatgcaacttccccattgatacctgtgattaacgtcactattgtagaacctaagattggccttttgagatatctttccaggttttttgcatgtctaacacccatgacttcacctccaccgccaacccctctcctgtggccccattcagaagtgattcagccagaaggaggacagcttcaattccctatgatttcatctcctccccaaccaatcagcagcaagcacctgttggctacccccaccccttcctccaaactgcctttgacaaacccctaacctaggagcttctaaggagatgatttgagtaggaactccatctcccatgtggcgtggctgtccttgtgtctattaaactctttctcttctaaaaaataaataaaataaataaaacgtctaccatctcatctccacatgcatttcattcattaatgggaggatataatttaaacccacattgcaagtttccttgtgttgttttctgtctttaaaatgatgattttagatatgtccaatgactcttagcaggatttctgctcatagccctccaaaataataaagcagctttgtaacttaaaatttttttgcttgaatatgtgtgtgtgtgtgtgtgtgtgtgtgtgtgtgtgtgtgtgtgagagagagagagagagagagagagattcaattttctggcagcatccccaaaacaaagtcttaccttttaaatttgatgtaattttttttttctgcagagagaagtaagaaatcaatagaaataaaagcaaacaatggtgaaaatgttatcttggtttcagggacacccacaaactttggtttctaaaactgtgagaagtctaggcagacccagagagatataggacttgagcactgatttcaagaagggctctgcatgttcccttagggaaattatcccctgtcctaggcagggcagtatcccagccagcatcaccaagacgtctagggtgatagaggaaggatattactccacataagtcacccagccgtccttcttcgtttctgcctcagcctcctctccaagcaaacttctggtgctggtgaattacaaactaggaagacagcgtctttgaagtgctgaaattttctgatacgttagatgaaactaactgaaggaatgagctgatggatcaggataaagtgagaatggctaacaggtccacctgaggttgatccctgatctttccatttacctggtggactagactagggcttgctctttagctcttctctagatgttttactagagagtagacacggaagagaatcaaagaatagaagagaaagagcagccttctttctccaggccactctgtccacagccatgagttccggcagcttccagcttcttgcagcactcccagaactgggctcactccatacacttggacatacaaacaggtagcccagcaaagctatctgccctgagttctgctggggcccctccctgtcagatattcccaaccttgtgacggcagcatcttcctttggatattacctcgggcaccccggtgattctttttggtgctttcagctcttgatactctaacaatctctgcgtgaaatttctctgttgaagcacgtagtgagatttttggtatcctgactggactgaccgacacatctaaagctaatttatcagaacaagtgagcaaagtgcttaatgaaatatggccggggtggtggctcaagcctgtaattccagcactttgggaggctgaggcaggcagatcacttgaggtcaggagttcaagaccaaactggccaacatgatgaaatgctgtttctactaaaaacacaaaaattagccgggggtggtggtgcatatgtgtaatccaagctactcgggaggctgagggaagagaatcacttgaatccagtcagcagaagttgcagtgagccgagatcctgccactgcactccagcctgggcgacgacaaagtgagaatgtctaaaaaaaacagaaatattacagacgtatgtatatatatagtgtgtgtatatgtgtgtgtatctatctatctctcacatctcctgacatatatttatagaacttttatatatatatacatatatatgtgtgtgtatatataataaagccaaaaaagttatcttatggaaatcttaggaattatatacctgtctaattatataaacacatacatacacacaattatatatagtatatataacatatttatatataactatatgcacaagaagaaactttatatatatttatatatacatatgaagatgaagatatatatctcacatctcctgccataaacttatactagttagatatatatgtgtgtgtgtgtgcataaaattaagaaagagaaataaagatatactgagaaaatatcagaaattatatatataaacatatataagcacatatatacacacaatgatatgaagttataaagtatatagtatatataccttatttatatgtgtttatatataacaaatatgcacaaaattatatatgtaaatatcagaaaataaatatgtaattatatagatgtcatatctcctgacatacatacatgtataagtttgtgtgtttgtgttcatatatataaaatgaagccatgaaaggcattaaaaggtactgtggaaatattaggaaataaataatatgtatatgtaaacatatttgtacacacatgattatataacatatatactttatatataatttttatatataatatacacacaagaagaaaatttatatatttatatcaacacatatgtgcaattatatatacatacatgtatatacatatatgtgtgtatatatatttcatatatcctgatacacatatataaagggcatcccatggaaataatagaaaaaaatatatatatatacacacacacataaatatatatacatacacacagttatagtatatataatatattcacgtatagtaaatatatgcacaataagaaaatgtatttgtacatatttaaatgtaactataggggcatatatgcaattatatatatacatacatatatccacactcacacacacaattgaatacagaaccaataaattggacaagcatgaaaaatctacaaaaccattttattgagtcacaatttcagattatggaaatctcctagaaggtgcttgcaagagataaaagtgtagaaaaatgcaggcaaaagtaagatactagacagtaacagttaattgcaatctggacaataggagtaaagaaaaataatatacttagaaaaaatatttgaaatatgaatgcatgcactcagcaagcagggccaatgtaagtgttctaaagtgacgacacttgacactaatgtggagcttggtatgtggtggcaagactcagtgccatgtaggcatttcctcatttattcttcacagagccctaggtagataatcatagtgttacctgcatattccagacaaagagagtgatgcttaccaggtagtgatctgttcaaccttaattctttcattgtattcgctttgttacaacgttttgacaattccggtgctttcgtgattatgcaatgtttcttttttttcttggtattttgttttgcgcaaaattttgattgctttaatacagtctcatgtttagaattctccatttacaatgacagtctaaatataactgtgaactctttgcaatgacctgaggaaagtattattaagcattgttccaagaatgatttttgctccctttttcagaaatagtcctccatctcttgacaaggttgagttacacaaagggatccctgagtggtttgaactggcctctggaacattctgttgctatcaaatgggactgtttgagtttcattaaaagatctcttatttattgaaagaaaaaatatatacaataatcgttaatttgtgcatacctttggaagtaagatgatgctacacatgttcttagcatcctccatacataatccaaaatatttccgctatgcatcctgagggacgtttccaagaaataccattgtgtgcaagaaagaagatgaagaaaacaaccaaacaattaatttgagtaatgtagaaattgttaataggatgaaatctagaagctaagatacaaatgagcatttagcagctcaaagaacagaaaaacccacaggaaaggattagagataaagataaatgattaaaggaaaacttgaggagatggaaaaaaggcaataagaactggggcaatcggagagcaagttgacttccttaaagtagtgcaagcaaggacctattttttttctcactagagaggcataattccaaaaaaaagttacaaatttattttgagttatcaggatcagttatgaaaatataggtgaaacattttgcaaactgagaagtggcttctcagttttggtataataataattatatatatatatatatggagaaatagataatagtttagacagatgatagctacagaatatagatagataatatataaatatataggatgatacataaatgatagataagtagacagatagatgatagatgattgatagatataggtagacgatagatatatagatagataggatgatagagatatagatggtaaataggtgattgattatatagatagataatagatcgagtttatacatagatatgatgatagatacatcaatagataatttatatagagattatagcttatatagatcatagatataggtagataatatatagataagatgattgacagatagataaacagagaagatgatagataaatgatttgaagtatttttaataactcaaaataatttttaaagagagaaagccttctgaagtagtgtgccctgtggcaaatttacactaagttcctagaaaacatactaaggaaaaaaaaaatctaccacaaccacaaaatgaagtgtttgctttatgaagttgactagcaacaaatgaattaagttgcctgtgaggctgtctcttcagagatcttagaaaataaagcagcatggtgattatgaggttaacataagtgaggcctccttcaattcactaaacatctcagtgaaacatttgtgttctttgtatccttgtaagtagactttttactttcctgtacacagaaaaacagctatctgctggatgttatattgtaaattgatttattttcatgtcctaccacagtaagtaatgtatgttctgcagtttgtcaccatccaaaaatagctcattttaattaaaactatatattatcttgttaacttcctgcatgagaaacccttcttcatctgcacattgcgataattatatcccacacttatttctggttactgttttttttaatgtcattggtgatttgctacagaggaacgaataaagtggacacacctgggtttgagttgcagctctacccttagtgatggtatgagcttgagtggcagctttgtttctcggttctgaaacagaaagtgttttacgcttgggtacagtttcagtgaagttcactgatggcttttctgtcatttttagctttttttgctcgaattgactttgtccatggacttcccagcatcttcttttctttatttgttcattttttctgcatctgtccatcactccctagaattatgaacttttaaaaaataaaaccttattttttagagcagctttaagttcacagcaaaatttagcagaagctacagacattttccatgtaccccctatctccacacatgcacaacctctttcatgtttgacattaacccaccatggtgatacatttattaccattgatgcacctacacaacatatcgttatcaacctgtaaccaggcaatttcaaaatgcattctgaaacattttttttctctttctcttaggtttcaagaggtaaactggaggcaaaccgcagagccttttttccttagccttaaaatacactccacgtaccactctttttcaccatatatacttccttcttttttatctaactgtatgctagtatctgacttcgtgtcttcgtagatgttccggggctgatcttgagacagacacaccaagcctagagatccagctgcaaagttccagagattacttcaaggtggctagccaacaacccagccattgtggagatgacatcagcccaaaggccaggtggactgggacccaagacagccaccagcataagacacacagacattttgctcagcccgaggtccaggtggactgggtcccaagacagccaccaggacaagacacaaaggcattgtactcagcccaattcttgcatgcctttcttaacaagttttcccctttttaaaccccttccttccccccaccaaattgaagtggttactttggataggcatccaatcatttccccttcactagttttggttaataaagtcattttctttctaccagacctcactcttgttactggactctgtacgcagtgagcatccggacctgtgttcagttacaaaccaatgtccacagtttacattagggttcactcagtgctgtgcatgctatgggcttgaacaaatgtatcatgccatgcagccaccgttgcagtatcatccaaaaaagctgtgcttattgctttcctaaaagcatgaggcttctggagttccgttctacaggaagagagaagagaaatggaatgaaccctaggattcattgcagcattattcacaatggccaagatggaaacaacctcggtggctgtctacagatgaatggagaaagaaaaatgatattaggcagccataaaaaagaaagaaatgctgccatcttcaacaacatgcgtgaacctagagaacactggactaagtaaaacaagtcagacacagga[134 bp omitted]cctggcaaaaccccatctctactaaaaatacaaaaattagcccagcatggtggcatacacctgtagtccaagctacttgggagactgaggcaggagaattgcttgaatccaggaggcggaagttgcagtgagctgagattgcaaattatttgcctaactatatgccaataagaaaaaatttcttccttccttccttttttctttcttctttcttttcttttctttctttcttctttttctttttctttctttctttcttctttcttctctctttctctctttctttcttctctctttctccctctttcttctttctttctttattttttcttttcctttctttctttcttctcttctctctcttctctctctctttgttctctctttctccctctctttctctctctctctttctctctctctttcttttttctttctttctttcttctcttctctctcttctctctttctctctttattctttctccctctctttctctctctctctttctttcttttttctttctttctttctttcctcttcctttcttttctttcttttttttttgtttggagacagagtctcgctctgtcgcccaggaagctccacctcccgggttcacgccattcttccgccacagcctccccagtagctgggactacaggcgcccgccaccacacccgactaatttttttgtatttgtagtagagacggggttt[136 bp omitted]caggctgaagtgcagtggcgttcaaacagagctcactgcagcctagaagtactgagcccaaccaatcctcccacctcagcctctgaagtagctgggactacaggcatgtaccaccacaccagctaatttgttaatgttttggtaaagacggggtgtctcttggttgcccaggctggtctcaggctcctgggctagagtgatccacctgcctcagcctcctaaagtgctgggattacagtcatgagctactgtgtccagccctgattttttcttttagaatagaatatagctaattatctttatagttgagctactgtaatccttttaaaagtaccatttggatttaaagattttaatctagttttcaaagttacactgagagaaataatagaaattccccgaggagttaactagtatttctctttaaataaaattaaattagaaaacaaaattcttggtagcagttaaatattttatacagatataataaaatgtgaattagttaaatcactgagcattcacatctttcactgaataaatttacatctcatataccttattaattgaagagaaaatgtatgctcatctcagatgtaaaagagaaagtatttgacaaacatctaccgacgttcatggtaaaagctctcagcaaattagcacaataagtaaccttcctatatatgataaagggactgtataataaaaaagaacttaaaatcatacctcctggtggattacctttatgcatatacacaagtagaaaatcaaaataaaaaataattgattacaagactataaaattcataaaattcttgggaataaatctaatgaaaatgtgtaaatctctatattaaaaaactatataaccttgatggaggatgtcaaaaaactcaaataaacacagataagtcacatgtttatagactggaagactcagtagtgtgataatttccaatatcttaaaattgatatatactttcagctgaatcaaatgaaagtcaggttatcttttaaaagcaggcatttttggggggagggaggatctagaagagctaagacaagttttggaagagcgaagttagaggactttacctaattttatgacttactttaaaattagagtaaataagctgggtgtggtggcatgtgcctgtaattccagcttctcgggaggctgaggtgggaggaaaacttgagcccaggaattggagtccaacctgggcaacatagcaagacctcatctctaaaataacagtaataaattagtgcaagcaataaaagtatggcaattgcatagaaagtttagatattgacccacccgcctaagtatggtctatttattttccacaaagcctccaaaccatcactattgaaaaacaagtgattttaaacaagtaatgatcaaaaatgctacacttatgaggaaatatcaatggtttggggatagtaaatagaaaaaggcagtagttaaatgtatttgcgagatactaaagtctaacgattgtcatgtggtatgggaaaattagagaatttgactgctagtgcaaaaggttgcaatgattaaggcaaggaattacataccagtacctcatgatatgtgaagcaattgtccttattacacaattggcagtgttgagtatatatctacagagaaaaatatttattaagaaatcctcatcaacatgaatcaatgcactttatttttcccccattgaattacttgtgtgcacttgaaaattacacattttctctgagtttgtgtgtgtgcataaaatatagaaggtaacgcttgtatcaaaaagtgtagggaattttccagcctaaacacagtttgccaaatttcaacctctttttgggcaggtggacttcagtcttgcagagcctagcactagaataatacttattaagcatatcatgcagggtgttttgactgcacaaacaaatacgtgctccttcaatgttttcctcgtttattagacgtgtcttaagaggtcattttgtgaccttccaggggctgtatcttaaccatgaagattcagaaacgtgagcttatgaatgcatggcaagttgatctgttgctcagaggcagaagatgtaaaataaacaaattccaagactgacaatgctagcatgccagattgttaatttacaatgcacacctctcactgaagctacgattttaagagaaacataaaactagtgcattttctatccatgtgtagacctacgtggcaagcaaaatgataatttggggttttcttgtttgtttttttcgtgagcaaagagtgggaaaggtaaactaaactattttaattgatcagactgagataatttaatctgtcctcctccagaagagcagtggtttactaagtgggattatggtatccgttgtctctgtccaggttgttgcagaaatggtggctggttactgggtctttgtcttgtattccaatttaccagtcagtgaaggcgttcttttttttttttttttttgagacacagtttccctctgtcacccaggctggagtgcagtggtgcaatctcagctcactgcaacctctgcctcccagattcaagcaattctcctgcctcagcctcctgagtagctgggattacaggaatgtgccaccatgcctggctaaattttttgtatttttagtacagaaggggttttgccatgttggccaggctggtcttgtactcctgacctcaagtgatctgcccgccttggcttcctaaagtgctgggattacaggcatgagccactgtgcctggcctggttttccttctgatagacacagaatgtctttagataggttaagacattaaatatagttacagatcgaaatggaccatccaatacatttaagatgacttcattttttttcatattctcagtttattttcaagtctcagttctgaaggaataagtatgtgtgtgtgtgtgtgtgtgagagagagagagagagattaaattctcagtttcctaagcacttgggggaaacttcactcaccctcctagatatgtggaccacttccagattatataattacctcatgcctttctcagtcatttttgctttcaactgcttttgttcagttccggtcctaaactgttgagtaattttgctgtgctctgtgggacagctgacacattttagttgtatacaaaatgattctcatattcatttgtagttgtggagttgttaggcaatttatgatccttttgtatgtaagatataataaaactggaggtcattatcattatgagaatcattcttccttttctgaatgtctcatggtactctgattttgtaagcaatgcctataaccttctctctaaccacaaagtcaactgtccatcatcgtgtctcagttcttctcactgtgtggaacaaatgtctctgatatttaccttgataaacagaatggagatctagaaggcgttattgtgtttgcactattacacacgtttaatagggcgcaaatatgaaataggtacatgttcaggaaaagttacattttttaaatcaactgctcgcctagctatgggagagaagacaaaatcacctaacatggaaagttgtccttatttataattgaacgaccccactaagttatactaatgtaaaggggatgaacatctattgtctaggagagagaaaaaggggaataagtgtgcttcttatgatgcagccaaggttgccttaacctgagctgataataagggtggaagaaatacctttgcaagaaggcttacatagttttagaagaacaaggacaaaaatacttgaaggacgttgtcttcaatcaagtcctgcagttagcggaagggaacagtggatcccaaacataataccttatggaaagaaaataggcctagtttggtgagcctggtgcaacatgagagtccttagaattggggcaagctattttgagaagagtcttcggttgatgcagaggaatttacattcagatcttagtatttagacatgccgaattggtgtttgtgcttcctgaaatggtaactaagtcataccctattaatcagtccagatcaagggttcagtggacttcatgtggcacagagacaattgctccgtgcatggatcaaaatctacttctctttttgcaatttggaaggagacagacgctcctgtttttagaagctgtgaaggggtcatatagagaagatttaagagaaaaaaagtataaaatatcttgctaattggccttgtgaaattgagctatcatttcagtgagagagagagagaagaagggagaaatgggaggaagatgaatggagaaatggacaggagagagagagagaaagagaaagagagagaaaggcagagagagagaaaggagggggaggagagagagagagacttctatgtgttctaagagggcgaagaaagttattcaatgattacaaatatgtaattacagaatcgcctactttttaggtggttgctccatcagttttaagaaccttaacataatttgattaaaattacctaaattagtgtctctctttaatgtgattatttgtgcttaaaatggcaccaccatgttaagttaaacctttcaaaattatgcaaaggtctatttttttctactctcccattttctctaacatcaattgagtcaactgctatacagtatttcttacctaatagataacatacgatatctaacagttatgggtggaagcctaatttttgtggttgtcaactcatgcttacacttctgtctttacttctgtaattagtgatgggcactgagatgaaaatcatctgtgtgttaaaattgccgccatcggcggatgccccaaatacccacagaatttcatcagtttaggaattttatcatccagagctgtaaggttcaaagcttaatccaattatgacccaggcatgactcagctcccaaatgctaactctgaccaatctctcctatcaaatgtctttgaaaaaaatccaaccagaggacaaagttatatagagagatgaaaatgtcagagatttactggaagctgtgacttatacaccatctcctcttgctttattagactctaaatgacttggtaagtatggaatcaaaggagaaaagaaaatatgccagcaaggtgatggttggatacatccatccccaagaaaaacaaacttaccaagctaacttaaatctctagttcatatagttctaaaacggaaattttcacaggactatctggtaaaacactaaaattgggctcttcatctttcattttttgaaaatgtgcaatttgtgaggaagtgctccctttattggtatatggtaccatcagatgtagctaagtgttctgcttgctttgaaatctaaagatttctactacatgtgaatgactttacaattttctaatttatttccatttgtactgattgtataacatatatctctgccttaaattttttaaaaatataaatatttctttaaaactgattggaatctattgactctccattggaaaaccttccactgaggaatatatgatcttacagaatttattacccaacatacagttttttattaatcttagagtcttatcagtaatctacacttttccaaatacttattgaactttcttttaaatctgtgaagattctatatatatagaatctcatgtatagaatacctatatattttatacctatatatagaaaatttcccttgccaaattgacttgtaatttactggcaatcatttctataatagagagtttaataaggtaatggttccaaatgtatactatctagatgtatgttgtttatatgtaaatatcttagatgcttaacatattattatattaaaattatgttatgtttatatataaatacaaaacctatcacagtttctcagtaagattacgcaaaagtaaagaaggtatttttttaacatctcttattccacatcttagtacatttgaggattttctttgccatagtaagctactgaatctcaaataaattgtttaaatgcgcgaagattgaagctctgcacaaagtcactcctaatgtgtcactatttcttcattttccatttgaatctaggagcatttgtttaggtttattaactttgaaactgctacagcaaaagaaatgtaatttgccataagtaactattgaacacagtgataccttcaacaccaagaattatctgctactccaaatagtttattaatgaaattctgatcatgtcctttacacgatcattacaaacaaattttgttttaaaatccaattctacaacatttagaaataaactttggagaggctaatctttaaaatgaacataaaaataacacttaagcactctagcaatggcggaaaagggacagaaaagcatggattcagtgtacagcctccttaagcaggtattttcttaggatttccctcctgcagatcccataagcctaaattcagacaaattctgtttatttaaaggagaaaaccgcaagacatgcttgcttaaaatatttaaagatgaatttgaaaagcccttcattggctgggctatggggcatgcctgtaataccaacactttgggaggctcaggcggcagattacttgaggtcaggagttcgagaccagcctgaccaacatgggaaaacccagtctctactgaaaatacaaaaattggccaggcatggtggtgtgcacctgttatcttagctactcgggaggctgaggcttagagcttgagccgcagaagtggaggtgacagtgagctgagattgtaccattgcactccagcctgggcaacagagaaagacttcttctcaaaaataaagatagatatatatatatacaaattttttaaaacccttcattatttggtatgcaaaaataattttccccttcatttgggaccaaagtgactaatagtgactgttttctcctttcttttttggaataaagatagaaagttaattttaggacacaagctggaaaaatctcacagttggatttttctatgaaaaagttgtcttgcatagcaaatcacaagcataaatggctaaatattttcacatattaataagctgttagcttgtagagtgagaattttgtccattgactgattggcaattttagtcaaatattgttacagtaaaagaatcttcattcagctcccctgtatagagtctttataatttatttgttaatattatttaaccatttttgtatggggtcctttaagttttcttattgatttttacttttttcatcctaggatttagatacataggatcattttttagtgttatgcattgaacataatatctgagaaattttttttcacttctttttgtttaagaattattttagagcaaaaaaatgtgtaatcctgatgttttgaaatcaatctatattctcctttgtggactatttatttttttaatgactgaagacatctcttcctaacctaaagacatacctagcttgtaatggatgttgtactacaaaccttacaattttacataaaaaaaaaagcatgatgaagagtacgtgacatgccagagatggagtattgtgttggaatgtaaggaaatgactcactgaagggatatttgggcacagaaagtgaagagagaggacaagtatatctgcagagagcatggtcaaagcagggaaaacatcaagtaccaaaatcctaaccacaaggaaacaagtatacgaggtgatggatatgttaatcaacttgatttaatcatttgacattggatacatatatcaaaacatctcagtgcacaccagaaacatataccatttttatgtgtcaaccaaaaaacaaatattttgaaaattcatcatagactaaggaaaacaaaaacaacgttctgaggcaggattatatagaagttcagtgtggttcgaggggaggaggcaggagtaatcttgataaaaggtgtcagagaaaaaatagcgatgagacctcatgggcattttatagggccatggtaagtgcttaacttctactctaaggaaggaaaccatttaggggttgagagttacattgcgcccttatctctctaggcatgtccatcttttaaaatgtatttcggcaataaagcgtaaataagatttagtcactaattttacttctctcctgattgtgggtctattgaaggtttctgtttcttcttgagtaatttcactactttccaagtatccatttcatctattttcatatttatcagtataaaattagttattgcaatataatttttaaaaacttcatagtatgtcttggttttctcttctaatgcgtacatttttgcatcatcagtccatttttcttctctcatatctaattcttctgaacgaatggcatttttcatgaaatctctttatgtgtggtgtagttgacgttttccatgtatttttatttcactttaattaaatcaggctctcaggtttgttattcatttttgtttgcttttatttcttctctttacttttcttaacttctttttcagagatcaacttcttaagttgtgcatttacataattgatttttagaccttcttatcttttttctattttcttcatgtacatgaaacaagttttaatttttaaactttcattttcattccttatgtgacccattttattttgaaattatagtttaaaattccagacagatatttatttagttattatctcattcattcatttaaatttatatttatttctaatgcgatgacattctatctttcaaaacataatctgtaatgtacctgtatccaggtgttggttgagacttaatttgtggcctaatttatgtgaattttaaaaattctgtctctctgcttgtaaaggattctgattgtagttttatacttatcaattagatcaagattgttaacttcgctgttcattttaaaaaatattttccaattgttctttccataaatgagagaccataatgattttgcttttgtctccgtattttgtagctatatgcatgtaaactggagacagggagatgtttaggttttaattgaactcttaggtccagaataaattaaaattgcatgtaaatttggattccatatacaacaccattttatatcattatacagtaagctttttctctaaaagttattcatctgatattaatgtagttacactactttttctttggttacttattgttcacctattttttttttttttttttttttttttttgagacggagtcttgctctgtcacccaggctggagtgccgtggtgcgatctccgctcactgcaaactccgccttccgggttcacgccattctcctgcctcagcctccggagtagctgggactacaggcgcccatcaccacgcccagctaattat[134 bp omitted]ccgctcctgggtaacttttttttttttttttttttttttttgagatggagtttcgctcttgttgcccaggatagagtacaatggcatgatctcggctcactgcaaccttcacctcgcgggttcaagcgattctcctgcctcagcctcctgagtagctgggattaaaggcatgtgccaccacgcccggctaattttgtatttttagtagaaatgaggtttctccacgatgttcaggctggtcttgaactcccgacctcaaatgatccgcctgcctcagcctcccaaagtgccgggattacaggtgtgagccactgcacccgacccataactgccagttttatacaaacctttatatccttaaattttagatatgtctcttgtttgtacaaagtacatagcaagatatttttgtctgtttgtatttaattcaaactttcttctttgctgaacttttactctgcttctcttatttcttttttatatattttgaataaatatatgacatttttcccagtctggatgggaatccttaaatcccatcttcctgaaactaaataatagcacttttgacatttctagtcaaaatgctgttagatattgcttttattacaattctatttttctcctgaattttaatcagaattatgtacaataattttttaataatgcatttatattttcagatctctacctcttcatgcagaattttttatttttccaagtcaactcctcaggccctcagaattctagtactttttatagctgagtctattctgtatcgtaacacatcctttgaattttctttttcatttcttttttttttttttttatatctttgagatagggtctcattctgtctcctaggctggagggcagtggcatgatcatggctcactccagctttgatctcctggactcaagcaatcttcccatctcagcctttcgagtatctgggaccacaggtgcacaccatcatgcctggctgtttttttttttaacttttatttttcgtagagatggggtcttgcccgtcttgaactcctgggctcaagtgataaacttttatttttaatatttttgtaataatataaccatacacaattgagagctactatacctcaacaaactgcattattatgaatacttgttaatgtaattgtatcatcaatgcaactaaattagtaaaacatttgttcaagtttttgactgtgtgcatgtagttgtttatctggaaattgtacccagtttgattctcattactttatcaaataggaaagaatgctttttttaaaaaaaagaaaaaaattaatcattaaaattgaacatcaaatggagtttattaataaatttgctttttaaataacagttattgctctagatgaaatactttttcttcttttactccaaactaaacaaataagattgtgattccttttgtaactgagttgatatggttaggctttgtgtccccactcaagtctcatcttgaatagtaatccctgtagtccccaggtgttgagggaggaactaggtggaggtaattgaatcacggggtttatataaaactggcaggtatgggccaggtgcggtggctcacacctgtaatcccagcactttgggaggccgtaattgaatcatttcccccatgctgttctcctgataatgagtgaatctcacgagatcttacggttttataagcatctagcatttcccctgcttgaactcactctgtcctgctgccctgtgaagaatgtacctgcttctcctttgccttccaccatgattgtaagtttcctgaggcctccccggcaatgcagaactgtaagtcaattaaatctctatcatttataaattacccagtctcaggtatttcttcatagcagtgtgagaacggactaatacactagtagttaaccatataaagtagaaaaaaattgaaaacatatcaaacataaatattaactaatatttaacacattgttacaatatattcatataaatcaggtgaagttttttattaataaagtaaaaatacaaaaatttatgaaaatacatgaacatacttgctcaaagaagatacagggaacttcaggaaggttttgggtggactgccagtatctggtcacctgttacaattattagctgaaaattgtcaaagtcaaattgatgctttgtgttacccttcacagtgagatctgaaatataatagaaattgtcttttgtgcataatgtgaggtagacatcaatattccttttttttttttaccctatagctaaggattctttgtatctctctgtgctgctgcctttgtcatgaatcaagtgacaatatatgtctgatcaacactccgttcttttctaattcatcttagtgtctctctttgtgtttaaagcacattgctttaattgttgcagtaattagtgactggtgtatgttttccaaacttcttatctctcaagattgtctcaccaaatcttagcattagtcatttccattacagttcattatcgacattgattttcacagaagcccagctttaattttgatttttttatggtgaattcatacttgataggtaaattggaggagatttgacacctttatataaacattaaaatattgatattcacatgcagttgagtgatagattctttaatgtacttcaagttattcaacgcatcaaagtttttaaaaattgtcattgagattttaggtatggggactggcataacaaaatacacacacaactctgaaaacattttaattctgaaatcatgatatattgtttataatttttgttcatttgagtgtagtgcaatattcatgtttaatgtgcattgtcaaaacaatattttcatttgttaaaacaaaaaaaacttagtttattaatatttgcaaaaatgaacaatggaagaaattcatccacttttatgtcctcatttgagctttatatttcccagttggataattgagttttcaaaataaaacttctgacaaaaaaaaaaaaaacacttcagggaaaatttggattggtagaatctgccaatagaacaaagatataaacagaataacaatattttgaagaagaacaagaatacaaatttaagaacacaacctggaaagaaatacaacttaaagtaagaaaaaaaaaaatgcactcaatgacataaattatacctgagtgaggagaccaactcattgaattaagataccaggtctattaattaaagaaagctatgctattatgcttgtcatccaaggcacagtaagatgtctagcttttaatggaagtcttgggtcccgaataaattaaaattgattttgctgcttttattttaagttgtacagtgacaaaaaacgatgaattcttagtctcacagagccaaactggaaagtcaacatcatgtttactgcaaaaagcaggtgcactgcaggatttaattgggtagtgaatttcattgaagaaaaaatactgtttttaataatcatttgtgtgttcactattactcttgtatttgttatggtattggttgctttacagtaatttctttcttttttttttctttttttttgagataggatctcactgtgttgcacaagctggagtgcagtggtgcaatcacagctcactgcagcctcaacctcctgggctcaagtgattctctcatctcagccccccaggtagctgggactacaggtgtacgccaccatgcccggctcagtttttgtattttttgtggagatagggtttcgacatgttgcccaggctgatcttaaattcccgggctcaaaggatcctcctgtcttggcctcccaaagtgctgggattacatgtgtgagccactgcaaacagcgtacagtaatttgtaatgagaaatgtatttctctatgaatttctaaccaatgaggtgccatctgtagacgtgctcactaaattactgagccatgtagtgttctcttcccttcaaatatttggaagtattacagtaagaacttctgacagatttggagaatttgggggtgttctgtgtgggaaacgtccaaggggaaaagaaaagacacacacacaatacctttaagggtaaacaacatttatcctatgtaaatggtaatacagatacaataagcaaatgatataataagcaaattgcaatgggaaggggagaagggaaaatacatatgtgtgtgtatatatatgtatgtatatatgtgtatacacacacacacacacacacacacacacacacacacacatatatatttacacttaccagaccatggaggaagcttcaccagaccgggaagcaacagcctgggctccagagtcggctgcctgtcccgcacagactaggagaggtctcatgaagcttcagcatagtctgggaccctagctctttttgttacaagttgtttggcataaggcctagtcacgagggcccttcatgactgggctcaaggaacacaaagaggtcaactcatttttgcgatcgtctgttgtttttcaataactatttcaatctattgaaatagagatttcccagaaacagcactggatgaatgcctcaaggggctcacacaacctgttctgggacttggtgaccattgtttgtgtctacattcaattgagttcaaatttaatatttaacttttcctccatatttggcctcaatttcatacccagttttaggaaaatacccttgcagataaatgggaaatacataattggtagaggttacagaatcagggtaagctgaggagaatcagaagcacaagtaacaagaaccacacccaccatggccaacgccaatgccagttggaaagccagtccacgatggggtcctgacggctagattctagacgttgtactcgcgcccacatacctttcgcaagaagggtgacatggcgggaattgtctgggatatatacacagcacttagtgtgtactcctccttgggctgcagtaagcatgtcaggtgccacatggttctgcaggacaactgtgcgcagttgagcacgttgatctaataataacataagcccagaactactatcattaagagccttttctgtgtgcaagcttaagactttggtttgctgctggagtaagacagtgcctgcagcaggatagagtattgtgacaggataccaccaccatggggttcgacgcacttgcaaccagcgatatttataagtttctaaattactagggagagaaatgtcatcatggaccgtaaatggaattaatggccacccccaagtgcatcttcctgtccagtgtgggggtagatatcgccaccctgagagcccgcatacccatagggccccccaggggacgatgaggacctggctgtaattatattgtggtaatagtatctcattaaagtgggaaagggtttgtgtttcattgagggcagtgttgttgatttggagaatgtgtttacaattatctaatgggagaaatcctaaggtggcattaagggagccatttaatgcctctaggcaaaggggagccttagaaaatccagcaactagcaaagctggttcctaatatataccattccatgcatatcgagccggaagcaaagacttttggtgcaaggtgagggtggattttgccctatgtcgggcttgggcaaagagtgcctgtttagtgtgagtgagagaggtccatgttggattgcaggtattattgttgtgaccccattggcagtggcatagccactctgtcgcattagcgggaatgattttccatggtagtccccttctggcggcctctgtcaattcagtgcaaagccaacactgactactgttcacttcccctgcagatgtggccatccaattgatgaatttgttatctgcctcagaaaggagaattcaggtgctggccatcaacaggagagttattctctgtagtaacaaaagcgaagagggacatgatattgtttttcatctttagggcattgtactatgccttcattttctgctcccatagctacaaggtcaccagccttaggggtgggatctgacagatgctgtacccatattttggctccagggtttaagctacgtgtaccagtgaatccgaatcccccggttctgtgtgtagcctttgttggggcagagatttcctcaggggttaattgctgacaaggtaccactaacaactgagcaacccgcatctgcggttttataacaaaaatatctggaggggtattacataaaatgacctttaactttccccggtaatcactgtcaattatgcccccatgtactgtaataccccgcattgcaagatgtaatccactcataatgtttgcacggtattataactcctaggccggtggctaccacgtatgtactttgggcaggaattattccaggcttgaaactatataagtccaaaccggcagcttctactgtatttctccaaggtaatatagcctctgggtggattttccagcatttcagcgagagaggtcggactacacctgcacacttagcaatttgtaggtgtggagtaagcattcggcttaacggggtctcagaagttgttaatggctgagtctttaaaacctgtagtgcatcaaacaggtgatccttccatttttctaacttaccttgccctaacacctttagctgttttttcaataacccattctttctttcaatgaagccagccgcccgcaggtggtaagggatacggaaaacccattcaatgccatgttgggtggcaaaggttgtctgtctgaatttgtgtgggaacaccataatataaaattaaaatatttaaagttttgatggtattggtttgattagcattgccgtaggcacatgctactagaaatcctgaatatgtatcctcggcagtgcataggtactgacatcctttggagtgtggcaatggaccaatgtaatccatttgccaaatttgtccgggcattttccccctatgaatgtgccccataaccctttgaggaactgcttggttttaactgctggcatgcagtgcattgggataaaattgtgcaaaccacatcctggggtaatgatattcctctttgctctcctcaaaccatggtcccgtggacacatagatgcccgcacctgtgatgcacccatcgcgtgagtgcagcccagtcctgttctcccaggcccgattctgcagtaatgtggaaatttgagcttgttgatctgcctgctgattaaatagtctgccaagagaaagcagagacgcgtaagcatttccaccaacatggaaaacagtgatagttgtagtgtgcgccagaatccagatatcttcccagtattgttttccccaaacctctttattcccgagtaaccatttgtttcgttgccattgggtcttgcaagtagtgaaaccatttgctattgaccaagagtaggcatacaggtgacaaatccccctggcctcctcctgaatagctgggaggatggctactagttcagccagctggctgctcccaccccttccttcatcagaaatgcttatgtttttaacaggattataagccgcagccttccagcatcgggttccaccaatgtatttggcagatccatcagtaaaccaagcgcgtttctgatcctctgggcttagttctttaaaggatttgcctcattggacaggggagatctccttccctatctgtaggatttgctcagtggtttcctgagttagcatgttttgtacatcctcaggtaaaaatgataccccctttggtcccggcttacccctatcttgtctataccatttctattttatgatgctactttcttgggcgtgccctattcgatgggttttaggggagcttctgacgcaagtcataataggaaacttaggtctcataaaaacatcatggttgaagcagaggggctctgtttccagcaaagcccaatagcaagctaacagttgcttttcgaaaggggtataagctttgccggcctctggcagcttctgggtccaaaaccccaaaggcaccctcttcccatcctgttcgtgacgccaaaaaatcttctgtgcaggaaatgcgtgaggggaaaagacacacacacaatacttttaagggtgaacaacctttatcccatgtaaatggcaatacagatataataagcaaattgcaatgccaaggggagaagggaaaaaaaaaaaaaaatatatatatatatatatatatatttacactcaccagactatggaggaagcatcaccagaccgggaagcaacagcctgggctccagagtctgccgcctgtccgtgcacagactaggagaggtctcatgaagcttccgcacggtctgggaccctagctctttttgtaacaagttgtttggcatgaggcccagtcacgggggcccttcataactgggctcaaggaatacaaaaaggtcaacccgtttttgtgattgtctgttgtttttcaataactaacatacaggaatagattgaaatagagatttctcccaaacagcgctggaggaatgcctcaaggggcttagacaacctgttccaggacttggtgaccattgtttgtgtccacgttcaattgagttcaaatttaatatttaacttttcctccacaggggaaaagtcttatcttttgttttaagtcaccgccaactttcctgttttctgaacattgatctaacaaatgcatattccaattaataacataaataaaatggagaaaatacattgatagtacatttttttggtgaaatttcagtattccatcacaagggagactatcacatttaatatataaatgagagaaagtcattactttgtacttcatttatgtgatacttcactagttaagttagtatcattacagacatatttaatgaattatttagaatccacaaatatgcatataaatgaggatggctctaaattaagcaaatattaaaatttaaattattaagatatgcaacctcttattgactttataaaagttaaattgttgactgccattaaattttatggttatttttctgaaaatatagcatatggtacatacacccagtggtgggagattttctccctcttgatttttttttctttaactgttctaacaaaatattatgtgccgtggggtttcctttttattctcagaacagctatattgtaagttttcccttcctctgtctaaattcttctgggccaggcatgttgaccttagtttcagtctggtattgaaatgctcctgtaaactgtatcatcacgagtttattaggtgagttcatagagcaagttggaaggatgaggttataaatgaattagagtccatcacaataagtggatgtggtagctttctggaacctgtaatggaataacacaatggaaaatagtttgcattttttgtgtatgtttattttccctaattattttttaacatacactgtattatagaagtaatagatgtttactgcagaaaattaacaaaattaaaacagtcaaaatattcattttttctctcatatttttgggcatgatatatgtaatattgtaactaatataatacacaagaaatatgtaattttatacttttcccggttttgactactataattaaattgaaagaaaatgcttgctgtcaaaaatagtgaacactgttcttaactctttccttgacagaattatttaaaacaacactgaaagtattcatcacaaagagaaacatgaacacatttaattctgttagaattacaaattttttcaagcagaatatatcatgaaagaaaggaaggcagttataaactggggaaagtattttcaaacagattgtaacaattacgttagtatttt[137 bp omitted]gatgaaaccctgcctctactaaaaatacaaacattagctgggcgtggtggcacgcacctgtagtcccagctactcggaaggctgaggcaggagaattgcttcaacctgggaggcagaggttgcagtgagctgagatcatgccattgcactccagcctgggtgacagagccagactccatctcaaaataataataataataagaagaataataaatagatgaatacttaaaagtctaacactagttattattaatttcagttttccttatgaagacctttctaacgttaagtaatatatttaaaaatccaattgttaatttaaccattttaaacctcattcattggctcttcataatataaaaaattgaacattaggaatctaggtttttaaatctctggtgggaataaatacattattacaaagatttttagattttcgtcctttatatgcggttctgtatatatgcgtgtaagtctcttacattttgtaagttaattctaaaaatcaaagtcaaatgcatctgttatggtttgatttatgggtctataaaaacttgataggttagaactccaaggaagaaaatacaattttgataaaggtacacaattgaaaaaaattgtatccttcacaacagatgtgggcagtcaacttttagaccttgtgtctttagtttgacctgtccttcagtgagtgtatataaaattctaagctaaaacatattttctgaaattgtgaaggtattgcatgtctatcttcttgcctactctaaatatatcaatcgttttcttgggaagttagtctttctttcacacttgtctgtagatctttacatgttctttcagttttggaagtcctctgcatatttaatatttgttagtatttgtaaaggttttcttcctgtctacctccttcttgttctctctctctctctctctctctgttgctctctcttgctctctctccacccccctgtctctttatctctctcctctctgtttctaaaaattcaacctaaaactttcaatatttatttaggaaatagaaagttttttttttcttttcccttttcttttttctttttttgtttttgagacaggatctcaatcttgcccgggctggagtacaacctccatctcccgggcttaagcaatcctcccgcctcagcctcctgagtagctgggattacaggcgtgtgccaccatgcctggctagttttttggtatttttggtagagatgtgatctctccatgttgcccaggctggtctctaactcctgagctcaagcaatctgtccacctcagcctcccaaaatgctgggattgcaggcgtgagtcaccgtgcctggtcagaaagcttgttttgttgttgttgttgttgttgttgttttgttttttgttttttttttctaatttccatttttttctacttttttctggtaagacggttatttaacttcctagatctgctttccttttcttttttaatcattttcctcacattttctataacttgtctatttttgattaatatattgctaaatgtcctttatatcatatttaaagaggtacaacttgtcctatttcttaatttctctatatttaaaaaagaaatagtcttatttcagatttctacaatgattgctagtttttttttttattgttgtgatttctagaaatttgtccttggctaacagtttcttaatagcttgaaattgcctaagaacatacaaaaataatttttttatttaatttcttttttgttactaagaatatgtgttattttttaaactttagtcttctttttttttctttttttttttttttcttttttgagcagagtctttgtgtgttgcccaggctggagggcagtggtgcaatcttcattgcaggctggaaatcctggactcaagcgatcctcccacttcagcctcccaagtagctgggactacaggtgcattccatcacatctggctaattgtcaaatattttttttgtagagtagggtcttcctctgttacccaggctggtctcaaactccttggctcaagcaatcttcttgcctctacttcccaacgtgttgagactacagacatgggccatggcacccaaccacttttgtactcttgaggttcctctttccagttttgttttccctgcctgatggggtcctatccatgtttgaattctcaactcagacttcactatttggtgactttgcttgcatacttttctacctcctttctgttctaccccatagtatcttacatatagtatctatccatagtatcccacacatgcccattaaacaaatggcaacatttcattaagggtgctgttacataatatttttaccccaactacactgagtgccttgatgtaacatgtctaatttcatctttagaggttagtgaactacgttgagtacaactgttttgctataaatgctgtcccatgctgttgactcccatggtctgccatatttaaatgattgcattttctaagcaggttcatattcattttattgtatctatgactctcacaagaccatttgcttattcattcatatttctcacagaaagaataaaatagtaacctgtaaccagaacattattttgctgactgctaaatgtgtcatatttagaagcctatggaaggaaaattacttctgctgattcccgatgctatatttatatgtgcatctctgaatatgagcatatatatttatatatatgtatatttgctcattgcatgtgcttgataaatagctttaaatgaataaatgcaataattactgaagccagtaaaacatttaagaaaacagattcttataaatttcttggaatgagaaaaccagaatagaaataaccagtgattcaagtaggaaacactaaaactcattaatctcttaggttgctattctgtacaatttttaattttcttgaagctttgtgtatttatttacaggtgtcttaaatgatatatgcagtcaaagctgtctgttattatagctgctcgaatgtgtgtgactaatcactcatatcataaattcattgatacagaatacatgtttaccaattaacaggtttttaagcatttgtactcctttttgccaaacctcatcagcttctcaactggaaatcttcctggacacttcctaacttttcacaaggctgtggatttcaagtgaatacacagttgaagcttggtgatgctcgttataaatagcaatcaccaaattcatgcagtatatggacttgcttactgccaactgccttctagaaatgtttcctgccttgattaaagcaagactctcatattctttttctagctttcagatcctttctcccctgttctaattctcttctctgtctgtctttgtgtgtgtgtctgtatatgtatgtgtatgtgtgtgtgtgtgcacatacaatcactgagtttactaaaatcaaaacttacactaccagccacgtatgtagtaatagcagtctttagcaatatgggtaattatggtcatcctttaatatattgtatgacagaagcatatcatattatatttctctcttccatggtcaggcacttatctttcacagaaacatactcataatggaaaggaaaagaagaatccttctccaaaaccaactccatccttgactggcctcttctgtctgatggtcagggactgatgaataaaaaaatagttactcagttctatagctgcatatcagtgtttttaaaacttgaatgtatttttatgtgtactcattttactatataaaattttggaagtaattattttaggacagttatgaaggcagactatcacaggtatccatgttttataaaattttaaggcaaatatgtcacagtgacaatctatgtttatatcttttgcaattttagagtcccaagcaaacatgaacaatagataatgcataacacaaaacctaactatccatttctttattactgtaagctatttagaatgtcatactttattcaagtcttctcttataaatacattatataacttcatttagtatttcactgtcaaaaatattcttattaatggagaaaccaaaatctgattttgacattctcaagatagaatttttaaaaatttttacttattttttaaacaataaaacggcatacatcaaagccataatactcaacttagttccttaaaataagtaggtaataaatgaaaaattttttatttcacattacttgaatgtattctttatttttgtatatttattttttcttcagaaatactattttaaaatgtatttattttaatccatgcccatttccccataagaaattgtatttcaatatgcaatgagtgtttattggaaaagccactctgataaaacaactacaatggtgaagttaataggatcccacaaatgactctttccaaagattggtgacaggagagtcaattggttaattcaatttagatcatatgtaaaccctagggatctggatgtctagttctcagcaattaattaattaaacccaactttatctgttgaagtaagctgcataagcaggattatttattgattatatataatcaagacaaaagtaagcagcatgaagacagaatcattacgaacccttcattaaacttatagtgcataactaaaagcaggttattcgataattacctttttataaactatattggcctttgagattaaagagtggctagaggtacacactaaatttgcacaggttctgcatgcttggaattacttatgcaataatattttaaaatgtaatcttaaatattttgatatttaatagtgttttatattttaatcatattttaactttaaattaagttaataaatattatatcactgcattgaaataatactcctatatgtaaaattagaaaatatcctttctctaccattttggatcaaagacataaggaggtgagaaatatcataataaatatccatgacaaataaataagttcacttaaagagtttataggttacaggcttggactttgccaccagacaaatactggtgccactatttgctaaatttgtgtgaaactcagcaagttaagcacattgggcttcagaatagtctttcataaaattagaaagatatcactacatatggagtgaggttttatgatttaatttatggtaaacactaatgtacaaagaaaatcaatgctttattaaaataaaaggtgtttatcacaaaaattacatttaataattacatgccaagagtttttaaagtcaattatgcacacatgcatacatacacatacatatgcacatataagtagacacatagataatagataaatgaaatagatagatgatagatagacatagataggatagataggtatagacaggtaaatagatggatagatggattgatggatagatagatacatgacagattggtgggtagatggatggatagataggtagatagatgatagatatatagatgaatagatggatggatgaatagatagattcatccatctagattcatccatctagatggatagatgaatagatgaatggatggagagatagatgggtgaatggatggatagatgatagatagatgggtgaatggatgaatggatggatagatagatgagtagatggatgaatggatgggtagatagatagatgggtagatggatgaatggatggatagatagatgagtagatggatgaatggatgggtagatagatggatgggtagatggatgaatggatggatggatggataggtagatagatggatagatggttgaatggatggatggatggatatatagatatatagatcaatagatggatggatgggataatggatagctagatgaataagtggatagatggataaatggatggatggatagacagataaatggatgaatggttgagtaaatggattgagagatggatagacatggagagatcaatgaatagatagatgagtggatggatagacagatggatagataatggatggatggatgaatagatagatcgatagatggatgaatagatggatggatagatagatgggtagaaggttgaatggatggatggatggatcaatggatggatggctgaataaatggacagatggatggatggatggatggattgatagatggacagacggagagatagatacacacatattaacatacatacatatatgcatacatacataggtgcatagataggtaaagatagatagatagagatgggtagacatagttttggttcagtatgctctgttcaataaattttttttatcaatattcagttattaaagagaacactccgtaagttaatgtttcttcttccagattatcatttttatatactttgtcaaaatattgatggaagtgtcatgttttttccactattagactctggccttgcagaactgtgctgtcttgtattctgggtatttcagtcttaaagaggaaatttccaaatgccacttcatttgacataagggaaaataaatacattttaaaagtcaagtgtcaggaagagagagggaggcagagagagagagagagttaaaagacatctgggtgatgtgttttagcggtattctgacctgatttataattgtaaactgagaaacctttcagctattccgcccagaggattctaagtaagttgcaaggctatgtgattgtatcggattctggcttccctcactcaattattttcagagtccactgcattatgtggtttgtttgaaaaaccatcagtttggtaattgacagacacacacatttaatgattgcttttattctcttggttttaaagggacacatattaggacattgttctttgtgtatcaaggggtgatttaggggcatgccatcctcaaagaaattttaattttgaaaagcacgtttaccttgaaaacatgccctctactcctttgctttatttttctccttagcacttaaatctacactatattttatatattttatttatttgaagtatagccatggccaccgcagcaatataaagttgattgtggcagaaacatagtctgtttcttttctatttcaccatctctcaggacgttaaatatatgccttagcttgatttattctggaaaatttagccttctctctaataaccgctcaacttccatgctatgtatgtctctttgataacctcaaaataaggacattggtgcagagaagctgcatgtcagatgttaatggattttgtgtttttttttttgaattttttatttttagggagagatcctcactctatcactcaagctggagtgcagtggtgcaatcacagctcattgcagcctcaaaatcctggtgtccagtgatcctctcacctcagcgtcccaagtagctgggactacggttgcacaccaccaccaaacccagcaaagttttctatctctttagaaattgggtcttgctgtgttgtccaggctggggtctccagccagcttcctgcctcagcctcccaaagcactagaattacggatgtgagccaccatgcccagcctttaatagatgttaagccacagtgctcagcctttaatagatattaatagaagaaaagttcttctcccaatgataccttccccttgagaggaaatttatatttattggtgttttgcaagtttgccaccagttgtatcttatttacagttggctccagataagataaaataaaatattcatttatagcatctgccgattttccatactcttattgccctatttattttcaccatttattattataatattttagtgtggtaaaatacacataacataaaatttatcattagtggcatgtagtacattcacaatttggacaaccatcatctccatcgatttcgacaatactttaatcaccccaaaaggagatcctgtgcccattagcagttattttatattccatctatccccacacccctaggcaaccactaattttttttctgtttctgtggatttgcccagtcttgacatttcgtatcagtggaattgtacaatccctttgtgtgtgtggcttttgtgtgtagcttcattcactgatcatgatgcttttaaggttcacctctgttgtagcacaggggtccccaggccccataccggtctgtggcctgttaggaaccgggccgcacagcaggaggtgagcaattacacgatggtgagttgtagaattatttcattctatagtacaatgtaataataatggaaataaagtgcacaatcaatgtaatgtgcttgaatcaccccccccccaccccaccatcaccatccatggaaaaattgtcttctacaacacctgtcactgctgccaaaaagtttggggacagtggatgttgtatgtgtcagtgttccactcctttctgcggctacagtgttgtagaaaacaatttggcggtacctccaaaacttaaatatagaattactttaggacccagcaattctactcttaggtatatattttaaataattgaaaacaagggttcgggccaggcacagtagctcatacctgtaatcccagcactttgggaggtcgaggtaggtggatcatttgaggtgaggggttcaagaccagcctggcctgtgggcggaagattacctaggtgccgaggcaagagactgaaggcacagactgtttcagtatattaaagaaaatagttagaataagaatagtcatcatacaaattagatatagagatgatcatggacaattatcaatcattattataaatattattaatcatcagcttttaatattactctttgttgcattactaatgtaaccaaggaataaccggcgggtatagggtcaggtgcagaagggactttgtgagaaattgtgtggaaggccccctggagaggtatacagccttctacctttgcagatgggtttaaaagcaaaatggagctgggagcagtggttcacgcctggaatcccaacactttgagaggcagaggcgggcggatcacctgagtccaggagtttgagaccagcctggccaacatggcaaaaccctgtctctacaaaaatacaaaaattacctgggctgggtggcacgcacctgtagtcctggctactcaggaggctgaggcaggagaatcatttgaacctgggaggcggaggtggcagtgagccaagatcacaccactgcactccagcctgggtgacagagccagactccgtctcaaaaaaataaaagataaagaataaaataaaaagtaataataataataataataataatgggaggctttttttttgcatgactcagtttccaagcttaacttttccttgtggcatggtgattttggggccctgagattttattttttattttcctttcaaatatacaagaacattttttccatgtgcttcatacaaggaagatgccaagttttctggaagcaggaagaacagttttctggtgactattcatcatgttttcctcttccgaaggggtgtctccttcaggagacagaaaacaagtctctttgtcatcaattcttccatcctgatgtccacgaatggacacagacaacactaaatagctaacagatgggagttttgtgcacacagataagtggctgtaagtgtgggtgatgcagccaaatcaatttttaatattatttgtagatttctgcaaacttcagaaaagaagtgtattgcacttctacaaacatatctattgatatataaataaatccaaagtatgcttatttgtcttacttatctgtgaagggaaagtcttcataaggaatgtgagcagaagttgggttctgtttgctacaatcacatagagaaatcccagtgcaggtctaagcatgtttccaagagctataacacaatttcagaattattttctttcttctgcaagtattgctatatccatttacttaaacttatttattttgcgtcaaattttctgcagaatccagacaacatcaaataagtgctgtgtcttaatggatacatcagcagcacaactttagattgaaacttttcttagaaagcactgaaacacaggctctcacaggagactttcagcacagaaaatggcatgtcaacattgcactgatatccttagatgggtcgcatacatattttatgaatgcacgaaaacagtctcacaataaattttagagtcatgtttatttcatatgcacgtgaacatggaacctacggaaaatttgcaattttcttttgatgcctgaccagaataaccagtaggtcaaagaatgtcatttacttgaacctatggtttgggg[182 bp omitted]gtggcgggcgcctgtagtcccagctactcgggaggctgaggcaggagaatggcgtgaaccagggaggcggagcttgcaccacactccagcctgggcgacagagcaagactccgtctcaaaaaaaaaagaaaaaaaaaaaagaaaaagaaaaacacctgagcatgagcatcctatagcaagacttaggacaccactaagccctgcagataatgcaggaatctgtagctggagggcacttattcgttaatgtaaaagactaaaagcaacagggaaaaaaacatccaaacatttgaggaaaactgtccaaaaaatagaaaataattcaggaggaaaatgaagttataaacattcagaatatgaaaagatagttagcctcttccgcccagtagctttgcaaacccccaaaatggacaatttcgttaaaatagtaagagttgttgaaactgtcactgaatttacttaaaatacaattattacaatgcttgtcaaataaattcgcaaatctagggacatatctttatttgaattgtggaattatgttatttagatattatacagttttaagaactaaactaccttatgtgaatatctcacgcatacagatcaatattttattcttctaagtgttaaatgaaatgtaacctaaagctgcctctgtacatattttaagctcagcctcaaggtgtctctgtatacagtgaagtgcagcctaactaggtctgtaaacagactagaactcactcttgtgccaatcactgacttttggccagtcaaaggctgccacctttcaaaccatgttcaaataaagcaaaatgctgaggtttcatcaatccaggtgtttgtctacctcactttcattttctctgtcactttcctttttctgtccataactttgacctctatgcagcctcagtctctctgaatctgttctggtttgagaactgccccatccatgaattcttctttgctaaattaaacactttaaatttaatttgtctaaggtttttcttttaacatgagtataatattatgtcaaataaaaatgcctttgctatactgtatttgctcaaaataaaactccaaaaggttatttaaaatctgcgtattcgtttgtgcacaattacttttcctggtgatatattttcctaggttgtagaggcatgcttcaattccagacagtggcactccagatgacctcttgaattggaattactgggttcaaatagctatcctgttcattaacaacctatgaaactgggaaaattacatagccttgtagggctgtactaccccaatttgtaaaatagagaaaagagtggtacctgttatccagggcaggtaaagaaacgaactgagacaatttcgtttacacagaacaatatcttgcacatgacatgtgatttaaaagccagaatcaataagagaggtaaaatgtatttgctcttgaaggatcagtaaaagagaccttctggggaatgatatgtgagatctgcaaatggtaagaacagcttgggcaacatagcgagaccctgtctctacaaaaaaaaatttaaattagccaagtgtggtggtgcatgcctgtaatcctttgggaggctgaggcgggaggattgttgaggccaggagtttaagaccagcctgggcaacataatgagaccttgtctctaaaaaaaaaaaaaatatatatatatatatatatatatatatatatatatatattagaaattagctgggtgcagtggcaggggcttatagtcgcagctactcagcaggctgtggtggaggattgtctgagcccaggagtccaaggttgcagtgagctatgattgtgccactacactccagcctgggcaaaaaacattaaaaaaattttaaaagccaggcatggtggctcagagctgtaatcctagcactttgggagtctgaggcaggcagattacctgaactcaggagttcgagaccagcctgggcaacatggtgaaacccaatcactactaacatacaaaaattacctggatgtggtggcatgcacctgtagttccagctacttaggaggctgaggcacagaaattgcttaaactctggaggtggtgcttgcagtgagctgagatcacaccactgcattccagcctgagcaacagagtgagactctctgtctcccgcccgcctccccccgaataaaataaataaataaataaaaataaaaaggtaataaggttaaagtaatcagtgtgttagaagtaaatataattaatgaggctggatataatttaaaaaactgtaagatcagaatctgccataatgtaacaaacaaacaaacaaaaaacacgtaacttagtgaatatattcattctattttttttaacttaagagcagctgaaatggtgtgtgaagctcttcataagaatttccttgtcttatgtcccatatttgaattccacttgaagatcagacagggttctcttttgctctcatggccaggatgcaagacaagacattaacatttcagagagttctactcttattttaaaatatgtaagatggtgtagttgtatggtgggactatggacttcatctgcacatttaaaaatacatcccttactaaaaaggaacccactataattagctgttataattcagatatataattgttttttgtcgtatataaaattgtatatactacatgtgtatgtaagtacgtattcacagctgccctcatgtgctgttcctatacccagtattcttttccagctgctctttgaatgatcgaatccttttagttcttcaggtctctggtttatcagcattcataggtttgctatttgcactttatcgaactagaactccatgccagccctgcagagctgtttgaatttcctaattatttgtttgttaatttatttgtcaatgtctctttgtcctattagggtagaaggtgctttagagaagagaatttgtgtttgtgagagctgcagagtccacggctctgcctgaattgcacatcacttattcagtaaattatgattgattgaatgattgtgaaagaggaatgttttccactttagggggaactgtgttcttctgggagtctcgttaagttttccactctcttgatagaaaaagcacatttgcaagtacctgtaacaaaacagtgttaccttgcattttcaaatggatacatgcattcaccgaaatggttaccaagttgcaacacctcagaggaagagtgaatctcccctggacggggtccctttgtgttcctgttggggtacataatgaaaagcacattgggcttaaacttcatgtgaaacaactcaatgtgtttcatttatttctgcttttcatgctcaactcttactcttgccgctgacagtttcaaacattctctgcatttgcagcctcctatgactaacaatggatacaaagtggatgaactaacgtaaatagatttcaaaataatttcaataagaaaattattggcctccttttccatctcttatttttcctcctcctcctcctgtttcttcttaactcgtactatctgtgttaatttttttaagtggtaaatgggaaaggcaagccttctaaatcacagttctgtcatattcactcaacaatttttttttttttttttttttttgagatggagtctcactctgtctttcaggctggagtgcagtggcgtgatctcagctcactgcaacctccacttcgcaggttcaagtgattctcatgcctcagcctcacaagtagctggggctacaggtgcacaccaccgtgcctcgctaatttttgtatttttggtagacaggatttcaccatattggccaggctggtcttgaacccctgacctcaggtgatccacctgcctcagtctcccaaagagctgggattacaggcatgagccacggcacccggcctcactaaaaaatttgaccacttctccttgtaaagtcttattcttaccttggtgttatcagaactaacaaaaacaattcaggcgattattagtttaagattctcaagagaggcatatttctttgaaattatttaaataaaaatgtagattaattgctgtggaaatgagaacacataatcactttagatattggtgaaaaatcctcgaggcaacattaaagtattcagaattcagagactacatacactaaattatgttttctcaatgtccttttttttctggaaaacctgttgacatgaaattagatttagaaacatatgtcttttttatataatcacaattaaatgatttttaatatacttaaatttctctgacatttttgcgtatgctttttaaattttacttaacctaaactcttcactagatgtatatcttttatttgtgtaattgttgataaagtattaactggcaatgaaaaaaatgtattttgaagttctaaatcctaaaaatatgttcttattcttaatgatggtcaggacacatatttttattaatagtaagccatacttaggcttaacaaatctgctatctcatgggaggataaacagaagtggaataaaagctcatgtcaaacatacaccacaacaaaactgcacttgcttacatcttagcaaagacaatggctggagagagctgtacggccaaatcagtacctgttgctggtgtgttctgccttggtgtggcttaatttattaatttccatcctgtataataaatagccgagagcaagccctgtgaccgtctggataggtggtttcatgagatggagatctaatcatgaagaaattttggatcacagccataggaagttaaatagcaacttggttggtgatatggtttggctgtgtccccacccaaatctcatcttgaattgtagctccttttggatcacagccataggaagttaaatagcaacttggtcggttgatatggtttggctgtgcccccacccaaatctcatcttgaattgtagctcccataatccccatgtgtcatgggagagacctggtgggaggtaattgaatcatgggggtgattacccacatgctgctgttctcaaaatagtgagttctcgctagatccgttggttttatagggggctcttccccttttgctcagcagttctcctttgcttccccttccaccacgattgtaagtttcctgaggcccccagccatgctgaactgtaagtcaattaagcctctttcctttttaaattatccagtctcaagtacgtctttattagcagtgtgagaacaaattaatataattggccaatgggaatcatgtgaatcttgtcaaagattgaggaggatttttctttttttcagatggagtatctctctgtcgcccaggctggagtgagtggcaccatctcggcacactgcaacctccacctcccaggttccagcgattctcctgcctcagcctccccagtagctgggactacaggtgcgtgccaccacatccgactaatttttgtattttcagtggagatagatggggtttcaccatgtttgccaggctggtcttgaactcctgaccacagatgatctgcccaccttggcctcccaaagtgctgggattacaggcatgagccactgcacccagcctgaggccagacggctaaactgaaagagcacactgtaacacacgccccctggggcttctggcgctgtaaacactcaaccctacaggctactgtggggtcagagctcatgctaccccacgacctgctcatctgcatactccccgtaggggtttgagctgcgggcaccaaagaagcgagccacaccccatctcatgccctgttagggggataagagaacttttgtcatttcaccagcatctgctttgggggaggccttaggtagcttccactccgcggtggaaggggaaggggagctgatgtgtgcagagatcacaggaagagagtggaaatgagagaaagagggggaaatgccaggctctttttaacaaccagctctagtgggaatgaatagagaagaactcactcccctgtcctccaggaaagacattaatctgttcatgagggacccacctttatgacccaaatacctctcattatgcttcatcttcaacattgcaatcacatttcaatgtgaggtttgtggggtcaaacagacaaactacagcagagagtaatataaatgccagggaagcttttgtattttttgaagcaagcattttttaagcaaaataatgtgtaaccatattaaaatgaatctactacatttattgtttaaatcagtttttcttttctctgaaattgctaaatttctgtttaggcattatttactaaggaaattcatactcaaggcacttgaaaatatttggtggtggttgttatttaatttttttgcagggggtgtttctttgagaattgcaagtggagttagatttttaaacacacacaaaacacacaggaaggcaccaaacaacaccatgattttacctgtcttgtataatcctactatgttattctaattctcttattctcctcctttttattttatttttaaaaatatttatttatttatttatttttgagatggagtcttgctctgttgctcaggctggagtgcagtcacaggatctcagctcaccacaacctccgcctcctgggttcaagtgattctcctgcctcagcctcctgagtagctgagattacaggcatgcaccaccatgcccagctaattttttatattgttttggtagagatggcattttgccatgccaaccaggctggtctcgaactcatttcctcagttgatccacccacctgtgcccattgctgcttcctctttctcttcttggctgaggaaagcagaaacgccagttaatcattgttatagcacgtagaaatctgcaggaaaaacctatagccttggatcacagcgaaaagaaagaaggctcttaaatatgactgaggtcagtctaaaggacttctcaaacaggaaggagcccatacttcaagcaggtttattttcatcatgtccactaacatcctgcagggaaaaacaagttttgaggcgactctcaacatcagcaaagatgaccaagagcaacacaatttgaaacaagaataatgactgcagtggatcaaaacagatttaaaagggttaataatgatacacctatcctccctcaacaccagaaaaaaaagatgaaaaaaatttaaacttcagttttattgggttctaggaattattagagtttagaaatgttatgtaagcagatactaacttctctcttccgaaatctacactgatgttagtttggccatgaaacttgcttggtccaatggaattggaaaatatataattcaaaaatctaaaccattagaattttgattttttatttttattttttttgagacagagtcttgctctgttgcacaggctagatggagtgcagtggcatgatcttggctcactgcaacctctgccttgagggttcaagtgattctcctgcctcagcctcctgagtagctgggattataggcactcaccatgacacttggctaattttttgcatttttagtagacacagggtttcactatattggccaggctggtctggcactcctggcctcaagtgatctgcctgcctcgtcctcccaaattgctgagattacaggcacgagccactgtacccagcctgaaattttattttatttttagacttaaaggcatgtgagtagaggaactaaatcatgtgacaggcagtgtaacttagtcaactgagacttttgcttctctgattatagattaagccatctctttaactgaaatgttttgtaaacgattgtacatttaaagggctccagggaaccctccttctccattcactgcagatcttcattatagattaactttcttcttacattcttcacacaaagtcttcatggctatcacactgtgtgagatggaaaattaaatacattcttttaatttggaaaggaaataaaaacaagctgtaaagaaaagaagctgtacagagaaaaaaaacaaactgtcgctagttaaattattgtaactcataaacaagctttgtctagaatatggtataatcctactaaatttattttgtttttatgcctatataaacaagatcttaactttttttcttttttttttttttagatggagtctcactctgtcacccaggctgaagtgcagtggtgcaatctcggctcactgcaacgtccacctcctgggttcaagtgattttcctgcctcagcctcccaagtagctgggactacaggtgtacgccaccacacctggctaatttttgtatttttttttaagtagagacggggtttcaccatattggccaggctggttttgaactcctgacctcatgatccactcgcctcagcctcccaaagtgctgggattacaggtgtgagccaccgctcccagcccaagttcttaacttttaacttcagagcgctggccctgtttctctggagtctgtttcctgggtggctattcctgatttgggctctaatacactctattcctaatcatattttctatatcttgttatttaacatagacaggatattactggatgtgacgcaaataaagttgcttgaagtgagctttcatagtaaaacctgccctcctgtaattctgccattgctataatgaaaagacatagtccactgcttcaagtaggtaggagctatgtgggtttgccctggaagtaacctgttgcttggaatcaagcccaagtctaggacagctaattccagagcctatttctggtagaaacacaggaaatgagtgggaatcagtatctttttttgttggatgttgagatggcttattatacagcattgctatgggctcaatgtttgggtccctcctaaaatgtatacggtgaagtcctctgacatggtttggctgtgtcctcacccacatctcatcttgaaatgtaggtaccataattctcacgtgttgtgggaggacccggggcaagtagttgaataatggggtgggtctttcctgtgctgttctcatgctagtgaataagtctcatgacatctgatggttttataaatgagagttcccctgcacatgctctcatgcctgctgctatgtaagacgtgactttgctcttcatccaccttcagccattattgtgatgcctccccagccatgtggaactgtgagttcattaaacctctttttctttataaattacccagttctgaatatgtctttattagtagcctgagaacagactaatacaccctcattcccaatggaatggccttgggagatagggcctttcagagataatcatgtttagatgagattatgaaggtcttgcccccatgatgcaattagtgtccttataagaagaggaagcagtatcagagctttctctgtgacaagaaggcagccatctgcaagccaagaaaggagcactcaatgggaaaccaaatgggcaaacaccctgctcatggacttacctgctccagaactgtgagaaagtacgtgtctgttgtataagcccccaggttcatggtattttgttctggcagttctacccttctaataccaacatactgtgtcagccatgaactggtgcataaatggacctgttacatttataacctattacattgatcatcttttaagattgctatataaaggtaaagaataagccagctataccatctgttttgtatggttccaggacatttctctttatagaaataatccagctaatagaaagaccgaaaagaactggaatttcaccatcttgaaaccaattatgaagtagtgaaacagtatatcatgaaaataaataatataataatggatttctaagtaatgatcattgatggttgttcaacaaaagagaggcaatctcggtgatggtatatacctataaagtatttttgataaaaaaataaaacttgtatgtgttcaagcctctactgctaagtacagaaaatatttaaaaacaaaagaaaaaggtaaggtttccctgcatatgtaatgaacaaatttcatactggataaaaactgcaggacaaatggtctttaaaaaaaaaaaactacattgccagaaaagaaaataaagaaaaagagattctaaatatttaaagagaccttaaaagctatatcaaataatgcagtgtgtagactttaattggattccaaccgaaacagattagtagtgtacatatatttgatactatccaggcaatcgaaatacttgctagattatggaaatattaattgtttttaatatttaatatttacatattgttaacatttaaagtagaatgatagtgtggttatatattaaaatagttctcatctttttgagattaatatcaaaatatttacaggtgaaatcatgtggtaggtagaaattgcttcagtaaatagggtagggcccagtgaagtggctcacacctgtaattccagtgatttaggaggatgaagagggaggatcatttgagctcacgtctttcagaccagcctgggcaaattttaaattaaaattttttgtagagatagggtctcattctatctctacaagaaattttaatattagcgaggtgttatggtatgcacctgtgttcccagctactcaggaggctgaggcaggaggatggcttgagccggagaggttgaggctgcagtgagccatgattgcaccactgcactccagcctgggcaagagagtgaaagaccctgtgtccccagccctgactaaataaatacataaatacataaataatatgcatgggggttagtggatacatgcgtagaaaaatgtgcgttgataactgaagggtaaaatgagttcattatacaattttatctatttttgtgttagttatgtataacaaaaggtaagttagtgtgtgtgtgtatctgtctgtttgtgagtcattctcaaatgggcgcaatttctgcctgtcccctaggcatttgacagtatctggtgacttttggggttgtcctaatttgtgggtggtagttgctcctcagatctagtgggtggagaccagggatgctgctcaacgtcctacattgcacaggacagtacaccatgtcaaataatcatctggccctaaatgtcaatagtaatgagacaggagagttcactggccctccttgcagggcatgcaacaggggtgcagctctctctttgactgctgtgagctcaaacacctacgggagggggagcacacagacaagcaggtgcaggagctggggcaagcgctttgggctctggccccatggtagtgtctatgggtggatgcttgtggccccagtgttgcaatgatcttttaggtgtgctgtctgcagatggcttaagtgttaaccagctcaatgtcccctctgcctttctgcaatggtggagggccagtgtgacagctttttgtatcctgatctcttgtctagcatcctggaagaattgggtcacacacagacttgaaggatgaatgcaggggttttattgaatggtggaagtggctctcagtgggatggatgggagctggaagggggatggagtgggaagatgatcctcccctggagtttggctgtccagcatccgaactcatcttcaaccacccccagccgaactcctctcagcactcagacattcctttccttctctctttctctgccatgccgttctgctattcatctgcttgtctcctcatctcctcatctgcctctggatcctgaggttcagggtttatatgggtacaggatagggggcatggcaggccaaaagcaactttttggggcagaaaaacagaaatacctgttctcatttagggctgcaggtatccaggcttgagggtggggcctttgctggggaactgccttcttctactcagtatttccctgtctcctgtctgtatcagtaacaaggtaaagaaatcctaacatattggtgtatggaaggagcgcatcataccggagatgggtctaatttgagagactctgctttaatacaaacatgacaataatgagattatgtggatttttcattcgtaagattgcaatgctgaatgcaaagttttgccctacctttctctagccattaatagggcagaatagcgcaccccttgacccctttgcttggattcaaactatgttgccatgtgattagtgtgtttttctgactcttgaggtgtttttctagcctcttctcaggaatatctcactccaaggacttcttttctcatccttctcttgtatgggtaccttaaacatctgctcctccatgattccaatgctgggagagccatcctgtaaagacagaatggagtctctcgattgttgatgtgagccagtgactaagacatagaaaaccattctctccatatggtagaggaaaagtcagagaaagaaacagggaagccttcttcttggacctagatgaggtgggagtgaagattttagaagaggagagaagggaaattgttggcagcattctccaaacttcatgagtgttctttgttgtttcataaatatgccttgtattgtttgtgacacacacacacaataagtatctatatatatgtatacaaacacacatatgtagagtatgtgcatatacatacaagtgtatatatacacatgcctatatttgtgtattatacacatatgtacatgttgaaaaattaatattgcaatatgtatttcataatgtcttccatcgaaacataaccttttagaaaaataatcataaccaaaagaatttttaaaatacaatttctggttactaaaaaataaatgcacatttgtagaagcagcttctttggtcatttgatatgtgtaattctggggtgttttttttctgagaatttcctcatatatctcctacaaagtcatcagaggaagaaaaaagagtagcgaagtctagataacatttgcatgcatgattaattcttggatgtttggtagatcaatggtatgggaaactgtctagatttgaatgctcaacttgacgcactgacaaattggaaattataaatcagaaacagaaagatcatcttcaaaaaaagtaatatgcaaacaagtagaatgaatctccaattgcataggattaacgcctttttttgagaaaccagggtcaacaagtattaatagcgtttaaaagttaattatctagaacagatatttttcctgaataaaatattatttttaaaactaggacatcaaagtgtattaaagcatgtctcttttttaaatcccatgactgtgattattttagagcatgagccaaatttacctctatgatacaggggactgacaaaaacacaaaacccatttaaaggctaagaatacaatttcatttggaagatcattaggagatgcacagaattcagattgcctccttacatagaaagagcttttaacacacttgcctctggctctctgcgggggatatccagaaaagattaacctaactagcaatgcaaagttgtattcatatttgctccataggaatattaccagaaacccattacatttaatcatgcaaattactgacactgtatgaaaacagccttgaaagcgtaaactttttcacaacctcagcaactctttccttacagtcgaatgcaaccaatgtaataagttttttttttaattgcatgcagaatttgcctcttcaatatgttcagttttcacaacgatttaaacatctttaacaatgaaggatgttggcagggcatacatgctagctcatcgtcagagagctggagtttttttttttttttaatttgagagaaggtctcattttgtcacctaggctggaaggcagtggtgtgatctcagctcactgcagcctgcacctcccaggctcaagcaatcctcccgcctcagcctcccgagtagctgagactacaggcatgtgttaccacatccggcttttttgtgtgtgtgtgtttttggtagacaggttcttgccatgttgcccaggctggtctccaactcttgacctccaatgatcctcctgccttggcctccgaaagtgctgagtttacaggcatgagccactgcacccaactgggagctggagttttcaaggtgttagagtgtcatatttggtgtgttcctttctgaaatagaaagtatatttaaagagcatgcatatgtggatgctgcagacaaccccagaaatcactttacattcatgatcagtgtttgcattaaaaactctgcttggtggaaaggattcaaagaagatagagagaaaattgcatcagtaacatgttagtcaataaacagaagagtaagaaaatgaccactttatatgtctatgtttcaggactattaaatttgcatagtgatacttacttaatcattcagttataagaaaagcatgtgcacactattttgtttgttgacagttcttatcaatagcagaagatttttggcatgagatccattttttgctgttaggagggtaaagaaactatgacatctaaaggatgcatatttctcagaagtatgtttatgataagtgaataatttctgggaacactgaagatctaaaaggaatactagaggtagctgtatattctcaaagcaacaccgagttatttgtggtttacaggacttcaaatcgaactaggttttaaaacataattgcaggaggccaatgtaacggtggccacctaaatccatatcttttaacacaacctccaaaaaaaatttataggtcaatagatacaattaatagataaaataaaaccaaggaaactctatgccttcagtataacgtataagaaaaaaataacactgtaaacttcaaataatttgaatgaagaaacaattttaacaaaaattctggagaagccatctcctaagcttgcacacagtacctgcaaaaatctctggcagagaactagggggttctatacaatattcaaagagaatgaaggccagatgtggtggctcacacctataatcctagtgctttgggaagccaaggtgggaggatttgagccctggattttgagaccagcctgggtaacatagtgaaactatatctctcccctgatccaaaacaataattagcctaatgttgtggcacatgcctgtacttccagccactcaagaggctgaggcaggaggattgcttgagcccaagagtttgacctgcagtgagctatgatttcactactgcactacagcctgggcaacagaaagagattctgtttcaaaaacagaacaaaaaataaggcaaggatgggaaaagcagtctaaagattgacccaatatactcctaaaaatagaaagtctacattaactgcaaaaatagtcataaaggtatcttgaatatcagatcattgactactaagatgaaactggaaggtttcagggtgctgctcactttgtcagaggtgttcaaaccagagcaactccatcttgaataggggctaggtaaaataaggctgagacctgctgggctgtattcccaggaggttaggcattctaagtcacaggatgaaatagcaggttagtacaggatacaggtcacaaagaacttgctgataaaacaggttgcagtaaagaagccaaaacctaccaaaaccaagatggcagcaagagtgactgctggtcatcctcgctgctacactcccaccagcactgtgacagttcacaaatgccatgacaacttcaagaagctatcctatatggtctacaaaggggaggcatgaataatccaccccttgtttagcatacaatcaagaaataaccataaaaatgggcaaccagcagccctcagagctgctctgcctgtgtagtagccattctttcattcctttactttctttttttttttttttttttttttgagacggagtttcacactgtcacccgggctggagtgcaatggcacaatctcggctcactgcaagctccacctcccaggttcacatgattctcctgcctcagtctcctgagtagctgggattacgggcacacaccaccacacctggctaattttttgtatttttagtagagacggggttttact[138 bp omitted]gactcaccccaaattctttcttgtgcaaggtccaagaaccttctcttaggttctgcatcagcacctcctttccaggaacaacttgacaaattttggggagtcagttgtaaaaaagaatgaaatgctgtctttggagatgatgtagtgaaaagaaatggaaaggaagagacattcaggacctttcacagaagaaaaaaatcaaggatacatgatgctactcccaaatacattttcccccgacccacacacacatatgacaccactcattgaagaagtttcacttttctgcagtgacataaaagttttcggttaaattctttgtcatccaccctgcgtacaaagtgcctagaccaaaatagccatcatgtaaaaactcatatgcaaagaaaatgaaaaatgggaatcagaacatttaagcaaatacaaatcccaaccccattcatgtcccacccttaatctcgaagttaaatgaaatttcaacctaacctgacactcccaattaaatatccagaattctccttctggatgccgatgaaaagagtcaaactgtaaaatatttgaagagatttattctgagccaaatatgagtgaccatggattgtgacacagccctcaggatgtcctgagaacatgtgcccaaaatggttcgagtgcagcttggttttatatattctggggagatcaaggttcttttgaattcttatagtggctgcccttagagacaacagatgacaagtgtttcctattcagatctttaaaaggtgctagactcttaattaatctttttaggattgggagggtctggaagaaaaagatgtagctatgttaatagagattctttacagatgcaaattttctcccacaaaagacagctttgcagagccatttcaaggtatggcaaagaaacatgttttggggtaaaatattttaactttttccttgtctcatactgttatgccagagtcagactggaaagtaagtcacaatatatagggttaaatgaaattcatctgatgaggatttatggtttgtagggcatgactctccagacctcttagataggaatttgggcaagataaaaaaatcagagcttagttctcatggatatgaaaggtttaccagaatgagagcacatgaaaaaattagaaaaacaaaaagtatactaaacaacttcctctgcctacacaagtgagacattagggagcacagtaaggcagtctctgagagattagaaacagctacagctaagccctgggagagagtgccccaggttagggttgtttaggaaatggtgatacaaccagagcacagaggtctccttgagttcaagagacaaaacacagcgcttgaggaggtcagggcagctagattttgcaaagcagaatagcacagagaagaaacaacaaaatgcaatttctgctaagagatttccttaactctttgcctgaacactgttctaggttcacatgctttcagacaggtcttttgaggtgggtgttggattaaatgtgggcaacattgggtatggtagcttgggcttggcttgcaatggaaaatttttgaaatgagtcttgaagaatgaagaattgatataataaacaagagagtttgctgctctacattatcaattatcctcagaagtgggctggttatccagttaaatcatctgatactataatacatagacttttcaggaagttcctaaatctagctatgaagttactcattggtttacaagcttctaatgctttgtatacattgcctggagcaagcagtaatgtctggttgatagaatcctgacattaagtgttgcgggaatcaggaggaccagagacgccacagggtaaagcagaagtattttattcagtgcactcagacccagtggattatcattcagagactgggcccagaacaaagacagcacttgacctttatacacacttcaaaaagggggttggctagcctgaaacaagcttacagtggtgcgaagcaaaagcaaggatacagaggcaaaacaaaggcagttaatcaaattgtgacaggtgcattactcaggattacacgtgacatcttgctatgtggcccagatggctattatctaggcttgctctagtgccttgcctgggcttatctcataaccttcactatgtcgcccaggtggctgtagtccaggcctgctcagatagctcatgaccttcactgtaccgcttagataaaacagaatgcttgaagttaccagttacagagaacaggaatctataaactcataccataagagaaacgaaaattgcttttctcctccctatgttgagggagtgctgggagagtctccagagcacattcctttgtgtcctaacttctcagatagtgtttatggaggctcttcctgggtctgggctgtgcctgttgctgcctctgggataagtcagcctaatacaggaaagccttttttttctttttatttttctttctttaatttccacctcatagttctaagcaccaacattcagttttctccttacaaagatgtatcatgcacatgctgtaaaaatggctgtggatatctagaaccatagttgtcaaactatgggctgtgggctggccaactgtttgtgataataaagttttattggtgcataaccacagtcttttttaatgcgctttctttggctgcattctcactacaacagcagttgactggttgagataaaaaccatgtggctgacccagcatggtggttcacacccgttatcccagcattttgggaggccaaggcgggaggattgcttaagcttaggattatggaatcagattttaatctgccctctgcaaggtggaccctccaggaaagccagtggtgtcattcagtctgagtccaaagacctgaggacctagagggacactgctgtaaaccctggagtctgcaatgcctgagaagcaagggctctgatgactgagggtagaagaagacagaggtccaagatcaagcagagctttgtcggcttgtaactacccaacaggttcaacttgcctgctgcctagacagagccaatttatcaagacaggggaattacagtaaagaaagagtaattcatgcagagccggttgtgcaggagactggagttttattactactcaaatcagtctcccagagcatttgggcagcagagtttttaaggacaacttggtgggtgggggaagaccagtgagtcaagagagctgattggttgggttggagatggaatcatgggaagttgaagctgtcctgttgtgctgagtccattcctgggtgggagccacaagataagatcagctggtttatcaatgtgggtggtgccagctgatccatcaagtgtgggatctgcaaaatatttcaggcactatttgtagaagcagtttagggagggtcagaatcttgtagcctccagctacatgactcctaaaccataatttctaatcttgtagctaatttgttagtccttcaaaggcagtctattccccaggcaagaaggaggtttgttttgggaaagggctgttatcatctttgttttaaactatgaactataaactaagttcctctcagttagttcaacctatgccaaggaaggaacaaggacagcttaaagtttagaagcaagatggagttggttggttagatctctttcacggtctcagtcataattttgcaaaggtgctaactgccttttgttctatgggggccctcagcagattggatgatacccatccacatgggtgagggaatatcttctttcctcagtctaccaactcatgtgttcatctctcctggaatcactctcacagacacacccagaaatgatgttttaccaacaattggggtatcccttagcccagtcaagtagatgcatacaattaatcatcacattgcttttctagaaaacataatgtgagccaataattccacaaatatttgggtttttcccaatgacagcattttaatatttctttttctgcttgttgtttaatatttttcaagtcaagatctgatcccatctgtttgaggttgggtgatgggttgcccagaggcaggttggtcaaaaatggcctccgctagaacaagtgaactctccttcctatggtctctcatccttcagtaggctagcctcggtagtaggagcctccaggagaagatgtggtaacagaaaagcacttttgaatgtgcctgcttatatcatgtgtctgctgacatcctattgcttaaagcagcagccctcaacctttttggcaccagggacaagtgtcatggaagactattgttccacagaccagggttggggggaaagtttcaggatgattaagggcattacatttattgtgcactttgtttctactattattccattgtaatatagaatgaaataattctacaacttaccatcatgtagaatcagtgggagccctgagcttgttttcctgcaactagatggtcccatatgggggtgacaggagacagtgacagatcatcaggcattagattctcataaggagcacacaacctagatccctcacatgtgcagttcacaatagggtttgcacctcctatgggaatctaatgctgccgctgatctgacaggagggggagctcaggcagctcaggcaagcgatggggagtggctgtaaatacagatgaagcttcactggctggcccgctgtttgcctcttgttgtgtgacccagttcctaacaggccacagaccagagggctggggacccttggcttaaagtgtgttacaaagaatgttcaaagaatatagagaaatagattccacttattgatgggggaaagaaaggtcatatgcaaatgtcctagacaaaaaaaatgaggatattagtgcaactaatctactgtatcaactttgcaaaatgtgcaaaaaacttggaatgaaatatttcttccaggagggtaacaatcgttgtgtctggtggttagtttatgggatatcttctttcttgttatctggtttttatataccatgaatttattttagcaagaaccaaactttgagagtactgaaagggaatcaatttgtgtttttctctctgaattgtggatgccctatataagatgtgatataaaatattccctcaaatgctcaaaggttgaacaaatgaaaaaaaaatgagcagaaaagagacaccaacagtccagagactttataaaaagggcagtagataaatatagaggagataaaatcaggatattgctgcccatttcaaaaggcaatttgaaaagctaatgtctgctgttgagcggaaaataggaatatgcctcttaggggcatggttgaggatactttcagtgagattatgcctttaatgaaccttgtttggggcagaggctgcaattagcttaacagcagggactaccagtagcatccaaagaaatgccaccatttctagctgccaggaaacaaaagttgcaaagaaattagattaatataatgttgccggtggcaagaaactgattttcctgtaaaattgtactgtatttcttctgttttattaaaaatgtagcactacacctactttgagaataactgcacctacttaagttatatgtgttttaattgaaactcaagtttcaggtaaaactaataataaaagttattattataatattgcaatttgttcattaggcagtaaacttaattgcatggtgtgagtcctgtctttgaagtaaattagtttttttttaaataatacattttctctgcatgggaatgaaaatttgtgtcctttaaaggcatgagttttatagtggcatttaaaattatataggattttttaggagtttcagataagtatagaaaaacagtgactcaaaatgtacaaaaatatccatgaagaccatttattcgggtgttgcgctatgcaagatcagattggagacgtgtgacttcctgaaaatctcacacgatgctttcttcttacaaactaggcttgcactcctggtccctttagaaaagtgcatatgccttatgttttatgtgttatttttacctacataggaatcttaaggaacaccatgaatagaattgatgaactgatatcagtttaagaagctatttttatttttagtgtgacaaacgtgagaagcagctggcacgggatcctccccgccatccatttcctgaacaccagggaatgtccatatgtgttcagaaaaaaaaaaaaaaaattgaaatgctataaaaagaaaagagtggttaccatttaaagccatggaacacagttccttttatatcagaagtcagcagaatttgaaggcaaattcctaacttttaacaacaaaatgcaggggacattggaaaggatatagaaaggactgtgttagtggagttgctaaaaatggactacaagcaatttctaactcaggcattagaaggaatgatggagaaggggagaggaaaggaaggacattgaaaacatagacattaaggttaggaacatcttctctctcttctggcttttctacatctttttttctgtcaaaagccaaatagtgaatatgtttaactttgtgggccacacatctctgtcacgatgagcaactttcccattgcagcatgggttaaaagaaaaactttagacaacttgaatttaacagtttcattgagcaaagaacaattcatgaatcgacccccagaccagaattggttcagagtgacccccgggctgcctcatggtcacataatatttatagacaggaaaaggaaagcaatccacaggagacaggagtgaggtacaaacacagctggattgcttacagctccgtgtttgccttatttagccatggcttgaacatttggctgcctttgattggctgaaactctgtgattggtacaagagcaggtggctgagcatggtggctcacacctgcaatctcagcactttgggagaccaaggtgggaggattgcttgagcccaagagctcaagaccagcctgggcaacatagtgagacccccatgtctacaaataattttaaaaattatatcaactgggcttgctgacactcctgtggtcccaagtactcaggaagctaaggtgggaggatcacctgagcccaggaggtggaggctgtggtgagccatgattgcaccactgcactgggagacagagtgagatcctgtctcccccacaccaaaaaaaaaaaaaaaaaaaaaaaagagtaggttagagtctgtttgcacaacgacttgggttaccgttcacttatggaaaaacctttaggctgaacttaaagcatgtaaggaagcagctttaggctgaacttaaggtaacatgtggaagcagtcatggacaatatgtcagcaaatgggcaccaagctctgctgcttggctctcagttattaaacacatcaaactcttctcacaggtatttaagaaggataaaaggttaaacattttcacttagtactcaggaagagttgttttcattgagtcgatttttaactttaatgtaattgaatgttaagttttgtggtacatatgcaggatgtgcaggtttgttacacaggtaaacgtgtaccatggtggtttgctgcacctactgacccatcacctaagtattaagcccagcatacattaactatttttcctaatgctctcccttcctctgcccccacaggccccagtgggtgttgttcccctccctgtgtccatatgttctcagtgttcagctcccacctatgagcgaaaacatgtggtatttggttttctgttcctgtgttagtttgctgaggataatggcttccagctccatccatgtccctgcaaaggacatgatcttgttcctttttatggctgcatagtattccaagatgtctatgtaccatattttctttatccagtcattattgatgggcatttgggttgattccacatctttgctgttgtgaatagtgctgcagtgaacatacatattcatgtatctttataatagaatgatttttgttcatttgggtacattcctagtaatggtattgctgggtcaaatggtatttctgg[132 bp omitted]gctccgcctaccgggttcacgccattctcctgcctcagcctcccgagtagctgggactacaggtgctcgccaccatgcccggctaatttttagtatttttagtagagacggggtttcaccgtgttagccaagatggtctcgatctcctgaccttgtgatccgtccatctcagccctctaaagtgctgggactagagacgtgagccaccgcgcccggccagtggaactattttacatttccaccaacagcgtataagagctcctttttcacttctgaggactgcaagaagaacctcaaagaagccttctgttttcatatgaaataccaaataaaccaaaatgtttgctcagaagatgcagatttgaatttatgtcacttttttctgttttttttttttcttattttttgctacatgaggaacaatagctgtccccctacacctataagaaaatgtaaaaactaggacattttatttagaacaaacatttattctccctgttaaccatcagttcttcaaaagtgacatgataccacatggggcaaacacagccaagagagtccactaactataaagccttgggaacagctcagaagggaacacacaagagaaaaaatttataggttttggctgtctgggttgcagggatttattttaagcctggccatttgatgtcggtatctgtttgtatttggacaaaccttcaatgaaatagcttggggttggttctgtggtattctttgagattcctatgtaggtaaaaatggcacatgaaatataagcacggaagagcttgggaatgagttttgaggaagatttgatttgataagcaagagaattttctgctttgaggttcaattatcctgaggaggatgttcaccctgatgagttacctaaagtttgaatattctgaatctatgaaatcattcactagcttacaactttacattcctttgcaagcattgttgggaaggaatattaaagccaggctgatgtagtcctgataattaagctgcgagtgctggcatcccagtttttgcttttgtttttgttttgagacagggtctcactctgtcactcagtttggagttcagtggctcgatcatggctcacagcagccttgaactcctaggctcaagcaatcgtcccacctcagcctcctgagtagctggaactacaggtgtgtgccatgatgtctggcaattttttttccttttttttttctttcgtagagatgggatctcatcatcttggccaggatggtctcagactcctgggctaaagcgatcttccggcctcagcctcccaaagtgctgggattacaggcatgagcatctggcctggcatcccagattttatcatatgctctattactgactgtaaacatttagaacagaggctggcaaattagggtctatgggttgtccaagcgtttttgtaaataaagtgttattgaaacacagccacacccatttgttgatgtgctttctgtaactttcgtcacagtaaactgtagagttgcgtagttgagacagactgcacaggtcacaaagtcaataatatttcctctctggccttttatggaaaaagtttgggccatcttaaaatgagcaaatatttcccacaaacacgtaggttaatttttttcttttaaaatgttgaattgggagggctgagggaagtgattttaaacctggaattctatatgtagcatcaaatgcaagataaaagaacacattttcagatacaaacaaataaaaccaataaaaataaaaataaaataaaatgtttaattggcaagtaaatattatatatatattcaaggtgtacaatataatgatttatgtatatactgtattgactattataaatagatgactattacactatatatagtgtaataactgtaatatatggtataatgactattacgtatattgtgtaacaactattatgtatagtgtaatgactattatatatagtataatgactattttatatagtacaatgattataatatatacataatagtgtaattactattatatgtagtataatgactattatatatatcatgtattgactgttttatatatataatgtaatgactataatgtatatatagtgtaatggctataatttatatagtgtaatgactattttatatgtatagtgaaatgactattatatatagttattgactattatatatgactattacactatatatagtgtaagattattaatatatagtgtaatgactataatatatagtataatgactataaaacgtgcatgtatacatagtgtcaagactattatatatagtgtaatgactattatatataaaacagtgtagtgatataatatatagtgtaatggctataatatataatagtgtaatgactattatatatgtaatagtgtaataactattttatatatttaaaatatagtgtattatcattacactgttatatataatagtgtattgacttaaattgaaaagacaggtaatttaatagcatataatagtgtgtg[158 bp omitted]aacaaaaattagctgggcgtggtggcgggcacctgtagtcccagctacttgggaggctgaggcaggagaatggcgtgaacccgggaagcagagcttgcagtgagcacagatggtgccactgcactccagcctgggcaacagagtgagactctgtctcaaaataaaaaaaagtgtaatgattataatacgtatatagtgtaatgactataatatacatattatagtgtaaagaccataattatatatagtgtaatgactactacatatataatagtataatgagtattatagatattgtaatgactattatagtgtaatgactataatatatatacaatgtaatcactattctatatatatagtataaggagtataatgtatataatattgtaataactataatgtacatatatatcacataatggctaacacaatcaaattattaagcccatccatcactaccatactgtacattagatgcccagaacttatacatcttataactgaacgttcgtatcctttgaccaacatctccccattcccccacccctcagcccctggaaaccacattctactctctgtttccattaagtcaacatttttagatttcatatataagtgagatcatgcagtacttgtctttctgtgtatggcttatttcactcagcttacatagcctaagcctgtctacaacattttgcattttttccttgtttttggaaggcatcataaactactagtagttatttcaactgtttctataagcctggtactgtggtatctccatgtcagtttcatattttacatataccaaacaagttatccttccatcttaagtgctgcctatgaaatgaactatattgattttaattgaaagaatatcatatttatttgtacttaaaaatgagttatgctgctagccacattatacaaagaaacttgcttaaaatgggaacactggtgtaagaaaggccatttttagtttattttaaattgaaacatgaaataatcataacttgcatgtgcatattaatttataaattttaaagcttttttatatatatagtatatttatgtatgtatatttacacacatatacatacactacatatagtgtccttttttatggaaatgagtaggacagataatgttttcttcaatgatctgtttacgaaacaaaattttaaggccaggtgcggtggctcatgcctgtaatcccagcactttgggaggccaaggcgggcagatcatttgaggccaggagttcaagaccagcctggccattatggtgaaacccagtctctaccaaaaatacaaaaaatttagccaggcttagaggcacatgcctgtagtcccagctacttgggaggctgaggcaggagaatcgcttgaacccaggatgtggaagttgcagtgagccgaggtcacgccactccactccactctactccagcctcggtgacagagcaagactctgtctcaaaaaaaaaaaagaaagaaaagaaagttttagaatgttttggtaagaccaaattttcaaaaatgattgaaacatatttttagaggaaagatacttgagaaaaggcaggtaatttaagaaagattgtgaatgaatgtgaatacaaagttaattttaaaatgtgaatgaattcatagccatactttgacatttcttagtccaatagtttgcttatacattctctttaatactgccaattttttaaagctggaaattacatctatatctgtaatatcaaaaaagatagtagttgttctaagagttcataaatcaatcctttctgtccattgatattcttttcctctaacacaaacatctcttttctctccattcgacaccaaaaatgtattcaaagaataaatgttataattctgaagattttagacatcaaagagagaagtgctgtcaacctttcagaaatacttttattaacatgagctacattgcaagaaaatgaactataacatgaatataaacactatctttctggactaaattcagagtggagttgattttatgcatgccttagatgagtttccatccaatttaaagttggagaaagaagaaaaaattatcctgaggatcaagagagagaacccctgggtctttttaagagcatcactgccatggatatcaaatgaaaaacagcatgaagattgttatgcgaacttttttgtcttatttgctgtctgcttatacagtgtgtaaaggagctgcttagagaaacatacacgatcacatatggtcaacgctccttcaagtttcatataaagatacacatttttcacattctagccatttcttaccgggccgtagaaaaaaaaaaagagagaaactatatagcaatcaagttgaacaaaaaccttttttctggtgaacacatatttttttcagagaacaagccacttacttgtgtattgaaagataatattttatcaaaataaataatttcaaaagattatgcaaaagcaattttagaaaatgggacctgattttttaagtcataaattatagaaaaatgcatgattctatataataaacctcatttcagaagtttatgtttctttacactttgagtatgactcactcatttattatttattaatagaatattcaccatatgagttggaaagacacataaaaataaaaagtaattaaaaagctagttcatggccggatgtggtgcctcaaggatgtaatgctagcactttgggaggctgagatgggctgatcgcttgagctcaggagttcgagactatccagggcaacataatgaaaccccatctctacaaaaaaatgcaaacattaacccagcattgtggaatgcacctgtagtctcagctactctggagtctgagatgggaggattgcttgagcccgggaggttgaggctgcagtgagctgtgatcttgccattgcactccagcctgggcaacagagtgagatctcactctaaaaaaattaaaaataaaaagctaatccattagttagaatcaaatttagattaattaaatattctgaaggatttttttttctttaatctttcaatttgcccttcatgccaccatttttctccatcttgctctccttctctccttcttctcttcttttcctcctctttctatttttctttttcaaaaatataaaataaaaattaattgaatgtgttcatttgagtgtcttgaaaaagcatgaaacctcaagaaatcaagagactgtcttcaaacctaagtacaacaacctgtcttctcctttttgcttctccaatgatgtcatttacaaactttaattaaactgcatattatatgatatttttctcattatctacgagattgtatggtctttgagtgcagagaataggctgtatagatcatgacatcctcaacaccacctatatggtatgaaaaatgttaggtggtcagcaatgcttgagaaataataaatggatgaatggttgaattaaagaattgtttgagccaaacactctgatagtagccatggagtctgcaaagaagatgctgtgacccttgaatttgggatggggtgcagattagtttttctgggatggaactgaacatgtgggtgattattaaggaaggccttcttgggcaacatctgtagaaagaaatggatgcatacaggaaagcatatgaatgagatagatcaatgtgggtgagtgcaaagatagatggtgatgaatcaatagatggatggatggcttataaataaataaatgaatggatggatgctgaatcagtagatggatgagtggatggatgaaaagatgggcaagtggataatgggtacattgatgggttgatgtatatatgtatagatatgtcggtacataaatgagtggatgggtagataggtgaatgaatgaatagatgggtagatgcacgggtaaatggttcaatggatgaatggattggtggatggatatgtgaatgaatgaatagtttgatgaatgggcagatggacaggtgaatgaatggatggatggatagatggatggataaatggatggatggatgaatggattggtggatgaaaaggtaaatgaatgaatggataggtagatggggaaaaagtggattggtggatgaaagggcagatggataggtaaaggaatgaatggataggtaggtggggaaaaagtggattggtggatgaaagggcagatggataggtaaaggaatgaatgaacgggtagatgaatagatggatagatgaataggcagatgaataagtgaatgaatggatggataggtagatgagtgaatggatgggcagatggataggtgaatgaatagatggatgtgtatatagatgaaagaatggattggtggatgaataggtgaattaatgaatgaatgggcagatggataggtgaatggatggatgggtgggtgaattgatggatggatggatggatggatagaaagacatatgcatatgtaaaaatacatgcatgcagtattttgtgtcagatgaattgccaatattgacaatacataacaatttttaaagttacaagtatagtaatttcataggaattatatgcttatatatattattcattaatattttcaaatgttttacttctatggagagagagaggggacagaaaaagaaaaaggaaaaaagggagaagcagacaggcagaagtagtgtccataatgaaccaaagcattcaaacacagaaaaatatacgttttagcaacaggaaagtcattagataaataaaatattagatatctagggcattacttatacacttattttgtgtatcagaggaaattattatttttttaattgtaacacttaatgcatcccatagaaagggctcctgatgctctctgtaaaagtgacttacttgtgcccatgacagccataatcacatgagaggaacaaatgggtatcatagatgttaggatgaaatagttgtgatttcgagcaaatagcctggctttctcaccagggatagaagagcttggcaagaatgcagaggatatcactagaaccaccacaaacacacaacggagaccttctatatacactgtacttacagaaacagaattgtttctgaccttctatatacactgtacttcttccagaaatagaattgtttctgcccagttacatttgaagttctgataaactccgaatgtagtattagtatgagcatatcctaactgtggcatgttacaaaatgcttatacagaaagagtatgcggcagttttctcaaatttgaattaaacagtgtgttgctgtaatttaatttgctaaatttagtaatcatcttatgcagaaagaggagtggctcctatagaggtttaggacatagataagtcttaaataaataggatatctttaagtgacactgagagcggaaatgatcatgatatccagagaaatttaagaactctgaataaatttcagaatcgttattcatactctgggcattagtcaactagattttttttgtttgtgtgagtgacgtgggtttctgggaaaaaaacgttttgggaatgcttgtatatctctattatttttctatcaattgggttcattttttggtttgagtgccctcatactgtaagttacatacaaaaagaccatgaatgcatatttatttcagaactattcagaagtggaaaacatttaggttgcatggccaatcttaacctccctttgtattcttctaccttaattcactttcaagaagttgtttgctgcatagaaaacataatcactgatattaattatgatttgattgtctcaaaggaggtaacatgcacaataaataaggaaattattattccaaatatagttatgtttaattatagcagaagagcaaaaggctttagaatcttccacacatccctgaaaaacgtactgtcctaggatatgattctccagggacaaaatgaaatgcagagaaaaggacattgcaggtgcgtaaagagaaacaataccaattagaaaagaaatgcatgaatggctgaccttttttagggagtttctctcacctgttatatgctacctctgcacttttataaatgccacaaaatgtatgagcagcttctatagaaagtttgcatctaactttacagaaattgtgtggaacataaaaaacacaataaaaaccagaattgaactctttcgtgtacatgtgtatcaatgtgttattttaccttaccttgaatatttaaaaataataaatatctaagcatctatcttcatgtatttatatttatctcatctattccatttattccatctatgtacatatgtatgtatgtatctatctatctgtctacctacctatccattcatctatgtatctccatctatttatctatcctatcgattttgtctatctacctatctctacttatccattcatccagccacctacctatcctatctatctgtctgtctgtctgtctgcctgtctatctatctatctacctatccctctagctatctagctagctaaattagataaacgatagctagctaggtggctattatttatctaatttatctaccttgtaaactcacatttaacactttccccaaaacatataaacctcttgtagaacaaactattaaacacaaggtaagattttaatataaatagattgtctctgttcttttctatccacaacaacaatgaaactacaatgagtattttatttttgcatagtttttatcattttgatataatttactactataatcagtgtcaatacatttaaatttctaataggcatctatttgtttttattttatttttaaaagcgagtatacacttaccatgagtcacctgtttaatgagtagtttgatcctgcaatacccgttttattacagaatcaaatattttaatgaaattctaatttgacaaatattttgatagtttaagattctgaatcacattaaagaaggtatttttatatttcaacatgaaaaactgctgggctacacatatccagtggttttgaatttgtgcaaaaatttttttgcattattcaaactatatgtgcaattactataaactgagtaaatgatagcatttgagtttcaatatattttcatggcaatattctatctccagaatcatgttgcctctatttgataagaaaatcagattgcaaagcctaagataatctgaagtgacagcaaaggataaaaagacatcagggaaagaactctgagcacaactctgtagagctggaaggccacatttatttaaagataaattgttaagatgaatgtcctgaggtatggagagtggacctttaaatcaataaacatggaaaagggccaatgatatgattcagagggagagagagagaaagaggagcgagagagagtgagacaaaagagggagagagggagagagagagagagagagagagagagagagagagagagagagaccttgtctttggagccatttgtagcacaatgaaccagtccacagcaagagtcaatagacataagaaaaggccaaggttatgattcagagagagaaagagagaggagaaaaagagaaagagagagagagagagagctcttgtctttggagccatttgtaacacaataaacaaatccacagcaaggctcaacagacagaagaaaaggcaaataaattgatttataggccatttgtaacacaataaagcaacccacagcaaggctatatttaaatctcagggtacaaaaatatcaccaaaaccaaataacaactgagacattggtgtctcgcaattatcaaacaagtgaattgatacaaattaattagccctgataatgagcatttacagataccttcaaattcaaaaaagaataaatgcatgcaaagcatcttcaaaatcttgacaaaatattgtgggtttgatttttcttcactgtgtttctttcaccttagagtttgtctccttgtggtagctgtcacatcaacttggcagcaaatggcagacatggaattttgggagtctgggtggcccacctgtgaatcctcttcacttcaactccccacctccagcatgagaagtcacactgaagataagtgctcagtcaataaaaccctggatacactcattaatgaaagaccgcgtcatgagagaagcatttaagggcatgagtaggtagacatgcataaaatcaaatgtgccacctcccccacgccatagtgcaacactccctaaatgctttttaacacacatggtagcaagaaactttggtgagacctaacttttttttggatgaataaaaacacagtgcttctgctcctcgtgagctttggtttgatgaagaaggcagcaatttaacaagcatggtggatgttaacactactgggtaatgctgagaactctgtcaggagtcacatgtgaacccccaaaatctgagacaggtctcaattaatttagaaggtttattttgctaaggttgaggacacgcgcccattacacaacctcaggaggtcctgatgacatgtgcccaaggtggccacagcatagtttggttttatacattttagggagaaatgagacctcaatcgacatgtgtaagatgaacattggtttgatctggaaaggctggacaactcgaaccggggagggggcctccaggtcataggtagacaagagacaaatggttgcattcttttgagtttctgcttagcctttccaaagaaggtgatatggtttggctgtgtccccacccaaatctcaacttgaattgtatctcccagaattcccacatgttgtgggagggacccaggaggaggtaattgaatcatgggggcgagtctttctcgtgctagtctcatgatagtaaataagtctcatgagatctgatgggtttatcaggggtttctgctttttcttcctcctcattttctcttgctgctgccatgtaagaagtgccttttgcctcccgccatgattctgaggcctcagaatcatagttccagccatgtggaactataattccaattaaacctcttttccttcccagtctcaggtgtgtctttatcagcagtgtgaaaatggactaatacaggaggccatcagatatgcgtttatctcagtgagcagaggggtgactttgaatagaatgggaggcagatttgccctaagaagttcccagcttgacttttcactttagcttagggattttgggtgcccaagatattttcctttcacacactgtacctctgaaacagctctgcttaacatgtctcatgaaatctgcacttgtaatccatagaccacattcaatacttaccaattctccacactgctcatttccactagcattttcttcagcctttgatgattctaacaatttgtattcttcctcttagttcctcatgatcttcttcaccctgttctaccaaatcattaactcttagtattattcagggttttctcacacagcacatttttttttctgtaaattgccctcatttgctcccagggagtccacgagtgtctatccttattgtagactcttatgattgtttgcttctttttggcttagtcttcttttctgatatctacataaaaattttttacattgtataaaaagtaattgtgtcattcattcctgatggtttccgtaataaattatcaccgagtggcttaaaacagcagaaatacattatcttacagtcttacaggtcagaagtcttacaagtcagaagtcttacatgctaaaataagggctatggctggtttgcatttgctcctggaggctgaaggggaaaatctgttttcttgccttttctggcttctagatgaaatcgcccatgttccttagctcataccctccttggtcatcttcacggccattaacatcacatctctctctgacccttcttctggcacgagagccaggaaatgttctgcacttttatcaacttttgtgatgacattgggccctcctgggtaaagcagggtattcttgcatgttgaaatcagtagccctaatcccatccacaaagtccttcttgccatgaaaggtaacatattcccaggggctgattctttgggcttaggcatctttttaaaatttatttttatttttaatttttgtgggtatatagtaagtgtatatatttatggagtacatgaagtgttttaatacaggcatgtaatgcatcatagtcatatcttggagaatgaggtatccatcctgtcaagcatttatgctttgtattacaaacaatccaatgatagtcttttagctatttttaagtatacaattaggttattattgaccatggacctaggcatctttgagagaccattattctgcatatcgcactgatatggtttggctatatccccacccaaaactcatcttgaattcccccttgttgtgggagaggcctggtgggaggtaattgaatcatgggggcaggtctttcctgtgccattctcgtgatagtgaataagtctcacaagatctgatggttctataagggggagtttccctgcacaagctctctttttgcctgccaccacccatgtaagatgtaatttgctcctccttgccttccggcatgattgtgaggcctccccaatgaaattgttatgttatactatacaatagttctcccttatttgtggttttgctttctgtagtttcagttactcatggtaaagtccgtaatatatgaaaagaaaggaagcaccaatgcatgcatgttcacataactttcattaaagcatattgttataatcattctattttattattagttgttaatttataaattagactttatcataagtaaacatgtataggaaaaagctacatatctatctatctatctatctatctatctatctatctatctatctatcgtctatctatctcattactatctgaggtttcaggcatccactgggggtgggagtatttttactatatatctcctgtggataagggagaactgctgtattagtataacaaacactactaaactcaagtgaaaaataaatattccctctaaaattctcatgaggtggtaaaaatgcaaatgagatcattgctctccccgctgaaaataaagcaatggcttctaatttattttatgataaagcagaaagctgagccatggcctttaagttcctacacaatctagttcctcttttaccacctaactcatcactttccattgtctctgcagctcagagcttcagccacactcattacacttctcgtgctagaacctgcctagctcagccattcctcccagctcatgtgctggttgtgcactttttcaaacactctttcttccctctcatcactaagacaacataaatcactccccgccaggctaccttatcataattagacttcatccatccctctgacatcttcttctctctttgctttgcaatcttgtcacttcctgaagtcacctgttaatgtatttggttattttcttgcatattttacactcagcgcccaaaggaatgcaactcatgagagcacaagcattgcctttcaggacacttgctataaacccaacccttgaacagatagtgagtactagatgctggatatctgcctagcacttcaatggaagctgcgctcaggaaagttgagcctaacacaaggccttagcaactagggaaatacccaggtaggaacatgaacagaaaactgccctattgattctaaaacttcaggcattagaagaaatcacaggtaattgaaacaaaaacagagaaagaatgaagaaagaccagaagttcactgcctgactttgttgttgttgccattgttattttttggcagaaagtaagttatttctgattatttccttctccctgtaatacaacacaatgcagtgtttatatctttattatcgtctctcatcaatgttttgttgtttatttgtttgcatgttttcaaagtagctcagtggtccccaacctttttggccccagtgtccagtttcatggaagacaatttttccatggatgaaggttggagggatggtttggggatgattcaagggcattacattcattgtgcatttgatttctattattattacattgtaatatacaatgaaatagttatacaactcatccaaatgtagaatcagtgggagcctggagcttgttttcttgcaactagatggccccgtctgggggtgatgggacacagtgacagatcatcagacattctcataaggagtgcacaacctagatccgttgcatgcatagttcacaatagggttcatgcttctatgagaacataatgcctcggatgatatgacgggaggcagagctcaggtggtaatgtgagtgatagcagctgtaaacacaaatgaagcttcacttgctcacccaccactcaccttttactgtgctgcccagttcccaacgggacatggacaagtacacctgacatagatcttccatgtataaacacatctccaaatagttcatttcttttggtgcaaatggaagtaatataatgctttcctcctcccttgtttgtttgtttattgttggcttgtttcttttgcttccctgtgatgagatcctggctatgtattctcagctgggttgtggaaccagtgccgtggactcctactcagagtagccattggccactcattgctgctgctaacttggataactcaattgaatcattgctggagttcccccttgaataaatattgttttcctcctcagaaacaaaagtatctctgtagggaggtacattaagaccatgccaataccccctttcactgatcattagagaatgcaaatcaaaaccacaatgagataccatctcacaccagtcagaagggctattatcaaaaagtcaaaagacaacagatgctggttaggttggggagaaaaaggaccccttttacactattgatgagaatgtaaattagttgtaccatggtggaagacagtgtgatgatttctcaaagacctaaagacagaaataccattcgacccagcaatcccattactgggtacataccctaaggaatataaattattctattataaagatacatacatgcatatgttcattgcagcactattcacaatagcaaagacatgaaatcaacctaaatgcctatcagtgccagactggatagagaaaatgtggtacatatataccatggaatagtatgcagtcataaaaggaaacaacatcatgtcctttgcagggacatgaatacagttggaagccattatcctcagcaaactaatgcaggatcagaaaaccaaatatcacatgttatcacttgtaaatgggagctcaatgacgagaacacatggacacatgcaggggaacacacactggggcctgttgggggtggttttgggggagggagagcatcaggaagaatagctaatggatgctgggattaatacctgggtgatgggatgatctgtgcagcaaaccatcatggtgcacacttcctatgtaacaagactgcccatcctgcacatgtacccctgaaatttaaagttgaagaaaaaaatttccctctatatttagtaagatttgatagtctagataaagaaaatgtagtacatgtaccccatggaatactatgcagccctaaagaagaataaaatcattttctttgcagcaacatggatggtgctgaaggccgttatcctaagtgaactaacacaagaacagaaaaccaagtattgcgtgtcttacttttaagtgggagccaaacatgggctacacatggacacaaagaaggaaataatagacaccagtgcctacttgagggtggagactgggaggagagaggtgattgaaaaactacatacctggtactatgctaattacatgggtggtgaaataatctgaacaccaaacacccgcgacacataatttacccatgtatcaaacctgcacatgtaccactgaacctaaaataaaagttaaaaaaaaaagatctgatagccaaactataccatggtggttacacaattatgtacatattttttccagttacatcagcagtcccccaacctttatggcacgagggattggtttcatggaagacagtttttccatggaccagtcgggggttggctgggggatggtttcaggctgattcaagcacattaccttgattgtgcactttttttctattattgttccattgtaatatataatgaaataattatatgactcaccatcatgcagaatcagtgggagccttgagcttgttttctgcaactagacaatcccatctaggggtgatgggagacagtaaaagatcgtcagacatcagattctcatgagaagtatgaaacctagacgccttacatgtgcagctcacaatagggctcaaggtcctgtgggaatcaaatgcggccgctgatctgacaggaggcagagctcaggcagtaatgcaagtgatggggagtggttgtgaatacagatgaaacttcactggcttgcccacccaccgctcacctcctgctgtgccaggactggtccttggtcagggggagcccctgaacaacagcgtttgctccatatttagcagtcaagactgggcattttattgtaaagagttattttttcacacatacacacacacacacacacacacacacatatatatatatatacacattttatgtatattaatgtatgcatatacacattgtatatgactttatatacatatgcatatatacttgtatgtacatatggatacatacaaatacacacctatttatattcaatatgaacagatgcattgctattttttgaaaggtttatagtttattattgtacttattttatttggtgcttaaattatccgagaaatgggatgttcttcattctggctcctacgtctttctgacatgcccttgtaatattgttgagcactttcttacattttgactattggaagatatttcaggctcttttcatatctacccagccacaaaactggagttggtcatacctataatgatgccaggtaagagataagtaatctggatgctagggtgtgctcattgctaatgggtgtctttgcttcttcttggatatttcagtgaagtgatacaggaattatatgtatttacacactaatatacacatgcctgggcttacatacacacacttacagatatgcgtatgcacatgtactggtaaatacacttacctatgcatattttaggaataatcaattcacactcataccttcaattccaagccattcctataaagatcttatctataggttcttttatttggatatcttttatcattgtgtgaatcatagctcctaacatcagaaagtgttaattctttttcttctggattaattatcataattattaaaagcgcactgtttatcacctctatatatgtaggtgtgtacacacacatatataatagttgcattcaaaagtaatgcaaccactacatttttacaataaataattacattcaaaaataatgagtttatcactttggaatatgctgctcaatataagagtgaagattttttcactactttatgtacagagggattgagtctacttattcctagaataagacatatgtcatggaaaaatagcactgagaagatgagaccatatttagcctctaataagtacaagatttgcaaatgttttatgaaacattattgaaactacatttatgaaataatattggcaactgcatatgttcagcaaaattcacagtatagtccccattaatctaataaatacatgataggagtaaatacataaacatgtatagaaagcaaaagacttgttctatagcatccaataaccttttggcaaatgataataaaaaaaggtcctctttcaagttataattctcattaaaagagaagacggcatcttaactccactacgtgcttcttttactagaagttatatgactcttgtttggcgtacacctgtgacttttggccactttttttctaaaataatgtaaaactgagccatagtttgagacaagagtgattgggagaattcaccaacctctttgcgactcttgagaatactgaaaaatataaaagcagaaagggcagtgatttgtagattagtgttatttttctgcatgtttactatagagcttcaaaatctaattgtaagatggatagataagcaaggtataggattctgccatgtgtttgtccacgggatcacataaggggtcaccactcttggtatttaattttctacagataatctttttgttttgtttttttacgatgttccccccagagcaattccttctttgaaaataggcagaaaaatgcagggttattaagtgaaagttatcaccactccttctgtgtaattctgctatcaatctgaattcagagtatcttctcatgggccagaagttttcagccctcacagaaataggaacgagactgggaaaaatgcaaatccctagctgtggtctaggctaccttgattaaagaagctcagtcaacagaaaagtctggactcattgtttgctgaataacctacgatattatttgacattccagcgcaatgcgtcatgaacaagaggtgccattctctgagagagaacgagaaggctgaaaaatgttctggtgaaaaagacccacaggcgtcccaacctcagccacaagcaagtttttctgaaaaaacacggttttagaggagtggccattccctgcattttctctggaaaatggccagttcattttcccagagggaataataaatcttctatttaacatttcttgattttctctgatttgctatactggctgccaccctatcctattcccatttgattattttttgcgtgaaacaagtgaagccctgtgtcaggtattacaactgtttttcatttcgcttagccatcaccttttggaagtatcccttaccctcaactgttaccattcaattgtaaatatatgaaaaaaatatttcaaacttaggagacattcagaaacattaaagaatatttcttaatgctggcaaagatatggtcaaagagaaactctcctagagtgttgatgggaatataaatttgtacaaccattatgaaaaacagtatggaggttcctcaaaaaactaaaaacagaactactatatgatccagcaattccactattggatatctatccaacgtaaaggaaatcagtacatcaaagagatatctgcaatcccttgtttattgcaacactatttcacaatagccaagatttgggagtaatctaagtgtttataaatggatgaatgaataaagaaaatgtcatatatacacaagagaatattattcagcataaaaaagaatgcaatgctgtcatttgcaacaacatggatggaattgggggacattatgttaagtgaaacaaaccagccacagaaagacaactttcacatgttctcattcatatgtaaatgttaaaaatgctaaaaattgaacccagggagatagggagtagaatggcagttaccagaggctgggaagggtagtagggagaggggcaaagtgtggatgattaatgtgtacaaaaatacagtcagatagaatgaataagatctactgttcagtagtacaatagggtgaatatagttaacaataatttgttatacattttaaaataactaaaataatggaattggaatgttcctaacacaaagaaatgatgaatgcttgaggtgatgggcattccagttagcctgatttgatcattacacgttgtctgcctgtatcaaaacagcacttgtacctcataaacatatactactattatataccaataataattaaaaaatttaaagttactccacataaaattactccaaattttaaaaagtgactccaaagacagccaatcaagcaaatgaatgaacattaaatccatactcaacatttcaccaatactgtatcaaggataagtggttgacatgcataatttaattgttctacaagtggaagatagagaaataataacactaacaaaaagtagaagtggattgggagagactgccaggtagaagttgaaatgaatttctctctccgttttcataaagaaagtaagaagatattttaaagatgatacattaaggtatagatttatgaatattcttaaagagtatagaggaatcactagaaaaattggaaataaaataagacaggaataattattggaagctagaatgatcatttttctccttaatatctgattttttgagaataagaatcaataatccatgtttaatattcataatcaaggaataattttgaattcatgattattaaattgaacattcatataacatattatataatgtccattttttaaggaaagtaacacacagaagtagaccctttatttataattgtcagatggaaaaaacaaatatcgcaaaatgaaagccaattttcttgtggtagatgactgtccatgttgaataaggagttattttttcctctctcctgagctgccttaactgtagggttctccaagttaaatctcccaccaaataagagtgggggtgagcatttctgagtggtgatgtttttaatgccactcagaagatgagcgttgagtgatgaattaaaggagaaacagatagaagttatgtttgaagcttgctctttggcaggtccaaatgtaaaaagccaaagtggaatcccaggaaatagtaaaagcacagcataataatttaaaaaaggtaatcattataaagacattgaaaataatcagataaaaagaaataatcaacagaataaacagacaacccacagaatgggagaaaagatttgcgaactgtgcactggacaaaggactagaatccagaatctacaaggatctcaaacaaatcaccaagagaaaaaaaaaagcaaataattttattaaaaagtgggcaaaagatatgaatagacgtctctcaaaagaagatatacagacagctaatgaagatatgaaaaaatgctcaatatcactaataatcagggaaatacaaattaaagcaaccatgagataccaccttactcctataagaatggccattattaaaaagtcagaaaaacaatagatgttggcatggatgtggggaaaaggaaacacttatgcactgctggtgggaatgtaaattagtacaacctctagggaaaatagtatggagattccttaaagagctaaaagtagatctacaatccaatccagcaatcccactactgggtatctacccaaataaaaataagtcatgatgtgaaaaagacacttgcatatgtatgtttacagcagcacaatttacaatggcaaaaatgtggaactaactcatcggctaatgagtagataaagaaaatgtggtatatatacaccatggaatactactcagccatagaaaggaatgaaataatgtcttttgcagcaacttggatggagctggaggccactattctaagtgaagtaactccggaacggaaaaccaaacattgtatgttctcacttataagtgagagctaagctatgaggatgcaaaggcagacagagtgatataatggacttcagagactcagaagcgggagggtgggaggggagtagggataaaaaagctacacatttggaacaatgtacactacgcaggtgatgggtgcactaaaatctcagtattcatcactatataattcatccgtgtgagaaaagaacttgcacatcaaacaatgaataaaataaaaaatatattttttaaaaatattaattttaaaaagcttaactggcccagtgtggaagagaaagttggtgttagatgaagaatgcactctgttatcagtaacatggtttctaatcaactggaaaacaccaagcctaagctagaaaaagtttgtgtttggagaaaaagggggcaattgacaaagtaaaagcaagtattcaagaaatgtatcattcatacgtattctaaacaaaatgttcatgaaaggggcatcatttgtgcttctgttgttgccaacgatgtggaaacactgataattgtagagatgaaaaattcaattgcaacaacatcattggctctgcagtttaaaataacaataattgcagagatgtacagatattatcagtgatttttaagttgtagagtcgtacccgtcactgaaaatgtgatcatttttgcaggcctaaataaaaccattgtctcaagagtataaaaatatgaataaattgatgggaattaaaatgcagaagtgggaacagaaaggcaggagagaggtaacagcgttaggaaagagaatacacaagaaaatagaaaggaattcagcttcatactatataatttaatttattgatgaatgatatacataaatgtggaacccagacaaaatgactttcaagggaaataaaaatcactcgaataccgacagaaggtatatgaagtgttattatgtaattatcatagaatatgtcaacgggattcttaaacatgcttaagtgtaaatgtttgctcctataaattttacataatataacataggctttcagagataatgaagctgtttagaatgtgtacaaagaaggaaaacttttaaagcattaatcttcctatttgatataactgaatgccaacacgtgtagattaaaattatttatgacgaattgatgcaagatttctacatccataacaagcagatatgagctcagaatgtaaatagtatgtttttcatgacctaatgggactaattccaataatgcaagaatgttttcacattggaaatggacatgtgtgtacatgtgcatttatgaatataagtgtaaattataactttgttttctggctagtaaaattcaacaggagagggaaaggggaggtcttggatataggtgaaacggtgacttagatgatggcaagaaaatctaagttgcataaggggatgagtcaatccaagcaggacctagttgaaaaggagaaattacgagtttcaagaagccagtgggagcatggatgagggatacaggaacggacggtttcaggtgtgaacacaacagggatgtgggtcacatttgcaggaaggtacttgtacttcctacaaagatggaggccattgagcagaatctaggatgcaggatgacaattccagaggactattgccttttgttctgcctcctatggctacatcacacatctgcatggaaggcgcccctgggaaaggtgtgctgtttcaataaatgagcgacatgagccatgcgagaatatctccagttccatatcaggtcattaagaccctcacctgaatttagtttgggtattttgacagagaataaaactgcatattacttttttcttttaaaaattgtatctccacttgtgtatacagaatagatactacttgtctataactagtggcaaaaaaagagacaaatggaaaaccctgtaatgttttctccttggagcacatggagtttctgaagcttaatctaggtagatagtattggataaacacattgatataaataatgtgtagtaatgttttccaaaaaaactcatcatgctaaggatttatggtagatgaaaatatacagtacatgaatatatggagaacgctaccattctccacggatcatgctgacataaaggatataatagggaattgattttctcaaatgaaaacaaaatgatggtgttatatccctgtgtttgcagaaagttattgctatagagattctgagatttgcacacttcatgagtgtaagaggtaagggagaaaataaaataaatgaagaaaaataatatatttaaggatctttttcaaaaacaaaacaaaaacaaaaactaagcatgtatcttaaaaatcagctttaacaattcacattttataccacctacccatttaaagtatacaattcaatggtttttagtatattcagagttttacatccattaccacaatcaattttagaacatttttgttatcgcaaaaagaaacctcatacccattagcagttactccacgtctcctccccccagctcctggcaaccaccaatttactttccatttctatggatttgcctattctggacagtttatataaatgaaattctacaatatgtggctttttatgtctggcttctttcactttgcagaaggtttttaattgtcatacatgttatagcatgtatcagtgactcattcctctttatggctgaatcattttccagtgtgtggatagactacttcttcatccattcattcattgatggaaacccgagttacttccactttttagctattatggaaaatgctgctgtgaacacttgtgcacatgtgtttatgtgggcatgtgtttctatttctcttgggtatacaccttcaagtgctattctggataatagcaaacaggcatctgaaacattgtcattcaactttattccaaagaaaataaaaggttctgtgcatgtgtgtgtttgtgggagcatgtgaacaacacaacaaagcaccgctttgttgcatgtgacttttcaatgactctatactaccgggtacacaaattcttcccagctctggatgaccttcatgtgttgtttacaatatagttgcaggttggatattcagaataactggaaaaatatcctgttatctctaaatatgattgcacacctctggtctacagtcacttgtattgtttctgctggcagagtgtcttttgagaaaagcatttgtaggacattttgtcaccttctgcccaaaggtatctgttcttctcattactcccttcacagattttaattttctttgaaatcctcataagagtatcttaaagtaaacatgggagagaaaaaatcagaactctagagaaattgctttcaaactcccccttcagcaatctaagtctgtcctcattatctttcttctatgcctcctaaatttttcagtttttttcaattttgggtttttttcttaagaagtcacctattgaaaacattggatactttcaaattatattttcccagtctgccagttcctgcaattaataaaaattttgcaatggaaatcatttaaaagtggattaagttttatagtcctcttatgcaaaggaggatttctagttgctgggagcaagaaaaggaatgtatacttttggaaggtaaaggaggctaaggattgatagtgtctatagcttcctgggatttactcccatctgctagaacatgcatggcaccaagacctccaggtctggcttattagcatgatgtccaggggttaatggatcagtggattgctttatggcagagattcccatcccctagtccatagaccagtaaggacttgttaagaaccaggctgcacagcaggaggtaagtgtcaggtaagcaagggaagcttcattcgtatttgcagccactccccattgcttacattatcacctgagctccacctcctgtcgatcagcggcagcattagattcccataggagtgcaaactccatcatgaactgtgcatgcaaaggatctaggttgcatggtccttatgagaatctagtgcctgatgatctgtcaccatctcccatcacccccagatgggacccactagttgcaggaaaacaagctcagggctcccaccgattcttcatgatggtgggttgtataattatttcattatatattacaatgtaatcatcacagaaataaagtgcacaataaatgtcatgcacttgaatcatcccgaaaccatccccactaacctggtccgtgaaaaaattgtcttcccaaagaccagtcccttgtgccaaaaaggttgggaaccactgttttatgggatatgcagggagtctgtatctcttaagactatactctgacaaaaggcggtaagttaacatggatctggggcaaagttacatgaaaacttttctccgtgccacacaaaaggtcattgtttctgagcctttcttctaaatagaatacaaaatgagatattttccaatctgacagctgcaagagtcctactaacctacttcagcaaagatactcccatcagacatagcagctgctctaggggcaattattagtctccactgtcagccaactgcatccttctctagaattggagtaaatttttatgattttaggttgacttgacaacccttctgaatataagtttaactttctcataccagaaacagggcttagtcaatcttgacagtttctggttctctatctcctcccagttcctcaaggtagttgatccaggtatctgccttagacaaccacctcctgaagatcacctccctatgggaaagctaggtacaacctacttgattgttctatcttgtctagtcactatgtatataaaaaacattatgttgtacacacacacacaaacatatatatacatatatacacatatatatatacacatgtgtatatatatacacacttatacacgtatatatacacatatatattatatatacacacaaatatattatatacacgtatatatacatacatacatatattatatatacacgtatatatatacatatataatatatacacatatatatacacatatacgtgtatatatatacacatatatacatatatatacgtatatgtgtgtgtatatatatatatatgaacttctgctacatccctaatccttgtcacactgctaataaagacatacctgagactgggtaatttatacagaaaaagaggtttaatggactcacagttctgcatggctcagaggcctcacaatcatggtggaaggcaaaggaggagcaaaggcacatcttacatggtggcaggcaagtaagtgtgtacagaggatctgccctttataaaaccaccagatcttgtgagacatattcactactacgagagcagcatgggaaaaacccacccccatgattcaattacctcccactgggtccctcccatgacatgtggggattgtgggagctacaattcaagatgagatttagatgggtacagagggaaaccatatcacatatacacagtgaaataattactagtcaagccagtgaacatatccatcatctcacatagttatctatattatgcatgtgatgaaaacaccaaaatctgccttttgccagtgtccagtatacaatattattaactgtagtcctccttctgtagattagatttctagatttactcattctgtataactgcaattttgtatcctttaactacatctcttcctttacttcaaagctaccattctactctctgtttctatgtatctaacttttttttaagatttcacatacaagtgagataatgcagtatttttctttccgtgcctagcttatttctcatagcataatgtcctccagtttcatccatatcattgcaaataaaagaacctcctttttaacggctgaataatatttcattgtgtatatctaccacaatatctttattcatgcatccctaaatggactcttaggttgttttcatatatttgctattgtgaataatactacaaatgaacatgggtgttcacatccttctttgagactttaattgtattgcctttggatatatattcagtagtgagactgctggatgatacagtggctctatttttaatttttgaagaactctcttcatgctgttttccatcatggttgtagtaatttacattctcagcaacagtttactagagctccctttcttctgcatcctctgtaacatttgttatctcttgtcttcctgataatgccatcctaacattagtgaggtggtatctcattaaagttttgatttgtaattgtttgattagtgatgttgagcaccttttcatatatctgtttgctatttttaagttttctatggagaaatgcctattcaagtcctttgtctgtattttaattgggttaattgtcttttgttattgagttgtgtgagttccttatatactttgaatattaaccccttgtcagatatatggtttacacatttttctcctgttctgtagagtgactttttctttttcttttttattttattttattttttttagttctgcagagttttttgttggatgtagtctcacttctctatttcttcttttgttacctgagctttcggtgtgatttgcaaaagtcattgtcgaggccagcaaaacacttttcctctgttttgttctagaagtttagttaaaggatttcaggttgtaagtttgggtttttaatccatgttgaattgacttctgtgtatggtggaagataagggtccaatttcactcttttgcatgttgacagccagatatccaaacaccatttaccaaagaggctattcttttttttctccattgtgtgttcttggtggccttgtcaagaatgagttgattgtatatgtttgcctttatttctgcgttctttattctattccctccgtgtgtctgttgttacaccagcatcatactgttttgattttactgtagctttgtagttataatttgaaatcataaagtttgatgcttccagctttctttttcttgcttaaggttgctatggctattcgggaccttttgtgattccatacaaattttagaacttgttttcctatttcagtgaaaaataccattggaattttgatagggattgtattgaatctgtctatctctttaggaagtatgggcagcttaacaatattaattcttccaatccacaggatcatcccatggatgtgaataagcacagctctgtgaccacccctgccatcaacagccctggcctgtgcaggaggctgactcagaccttctgagggaagttctctcaacagcacattcctgactgccttagtgaagggtatgttctctgcacgttttttacaggacaaacccgggactatatcaaagaatgttccctccaaacttggaaggaacccagagaccaaagaatgcctcagacaagtccagcttgctgagtagatgcatttattaggacttaaatataaagtactcctgggcagcagctggacagctccagagatctgccctgctgcctgtctcaaagctgcttttaagctaatattctgactctttacctactgcatgtgatgagactgtttttcttggtatatatctagatatgctctgggatgtttgagttctcagagacacctgctcctaggctgggcatcacagccttggctcactgcctggctttcagggttcaagtagcagacatacagtcttaaataacctggtgtcttaagcactcatgaaaaattaccagctgaagtatctcatagccatatatatatatatatatatatatatatatatatatatatatatatatatatatcagcacagcagtggtgactgcagaatggcagagccagtcaccgctttcagcttttcctccctgagtacttgagcaatgcatatccatgaccaacccacattgatacatttatgtgtattgtggcatgcgtattttcttttcttttttttcaagacagggtctgcttttttacagatgcattctgccatgactggctaattaaaaaaatatattttagtagagatgatgagattttgctctgttgcccagcctggtcttgaacttcagaaatccagaagtccagaattccctttggaaaaaagtggggcagtgagacatttgcagcccatactgtctgagctattattgtagagttcctccttctaggaatcaagccatttctcagcctgtgggttctagattagaaaattgctttatttatttatttatttatttttgaaacagagtctccctttgtcacccaggctggagtgcaagggtgagatcatggctcactgtagtttccaactcctggactcaaacaatccttctagcttagccccctgagtagctgggaccacaggtgcacaccattatgcgtggataatttttacattttttatacaggtgaagtcttgccatattgcccaggttggtcttgaactcctgggctcaagtgatcctcctcccttggcctcccaaagtgctgggtttttaggtgtgggccattgtgcttggcgggtatacacattttcaaagctcatggaactatattctcaaaatacatttattccattatatataaatgatgcctcaataaagttgatttcaaaaaagggaattttcttagagaggatttctcctcctggatactactgacatttgggactgggtaattctttgtggtgggggctgtcctatgcattgtaagatgtttagcagcacctctggcctctgcccactagggaacatccctgactctattccctcttccgcactgggccatgacaaacaaaaatgtctacagacaaatgttcaattatcaaatgttccctagtagacaaaacatccaccagttggaaactgcttatctaatgccacaatacttggttcacttaaatgacaaaataaatgaaagacactgaaatcagcagacaacccagaaatggtcaccagtaaataagagtttttagtgcatgaggaagataatgcatttagtgagtgttagaaacattagtcttgcatgttttttaaataaatgcaaactttggaaaaaacaaatgtaggtctctattttacgccaaacgtcaaaattccagagatatgcagttagagttaaattgcctgatacaatgagaaaaagaacatagaggtgggtatgaccttaaagcagagacagtccttctaagtaatttcagagatagaacttcaaagggggatgggatttttgttacttaagctcaataagtcagatagaatgattgcacctcaaagcaaatttgtccatagcttcaaatggaatggttgcatctcagagcacgtatcccctccccatccagcactgaagcccagaatgaaatgtgaccataaaaatttgcactactaatactgtaatcaatcaaataacattttttccctacctggaagcctaaattatattgaattatatactataaattaaattgatatatttattattttcaatccctctgtgtgatatgcatggagaaaatatatcgcaaggtttatggtttaactaatcatttaaaaagaagaataatacaattttcttgcaggaaaatggagatataagccttatgcatatatataaagtatgcttttctcatatttaaattaagagaaatatgactattttgacattacataatgacatataaggactataaaggtttttgtttccaacagggagactatgccactaaaattgcattaaatcagaagaattatcgatggcaatataaaacaaaaacagaagtcagaatcacagaaaaatatttgaaaattcattaaaaatattacacaatgcataactgcaagtttttgttcctgacatacttacgtatagaagcaacatattctaaaatacagtgatttaatgaagttcagtgataaacagttgacatatctctcatttgaaaatatgttaaaatgatgaataatttggtcaatgattattgatggagtgctgatactagaaaaccacatggttttgtacatttctattatcagccaagaatgacttaatttttcttttcttagtgaggtatatttggttagttggctacgcaacatctatatgcccatttttttccagctatcagaaatcctaaaagtgtgacagcaatgtgaaataaatcaagtgattaatcaatattgatccaatgcaatcatgacatttctcttcctgcttacccaacttctcctgggccatgtgacctgtacagccagtaatgtacatggtgtatccactggtgaagggagtggtgtggccatctgtcctccatctctctgcctgatgtgtagacaggaagcagaaaaacattctcatggagcctcttatcccctgccagaaccgacagaatttctttgcttgaccaaactgtggtcatgctcctaaaccttatcttaggtccttctgtgcacttccttataaaatccagttttagcaagaaccctgctaagccagtttagcaagaacgcttcactctccatatctgttcagacttctcatccccctccctcccccaggtgatgtttgatttcactggcctgtcttcagctaaaatcctgttaggtcagcttagccagaatccctgtcatccttggtgtctcctcttagtcattttccatccactgacctccgccctgctccccggctataaatccccacttgtccatgctatattgagagttgagcccaattcctctcccccactgcaagaccccattgccatagtccctgtatctatcccaatagcccagaataatgtctattttaccatgctttaacaggcataattaatatttcttttatttaacacggcataccatgttcaggcttctggttagctgagaaaattagcaccctgtatgtttaatccatctagagttagatgatagttgctgttttaggctgagctttatcctctccaaaattcacatgttgagacattaatccccaggacctcagagtgtgactgtgtttggaggtggggcctctagacaggtgattaacataaaatgaggttgttactgtggaccctaagccaataggatgggggtccttataagaagagatgaggacacagacacgcacagagggaccaccatgtgaagacacagggagaaggtggtgcctacaagtcaaggggagaggcctcaggaggaaccagccccgcccacgcctagatcttgaacttccagactccagaactgtgggacaatcaatgtctgttgtttctaagccacctagtctatggtattctattatagcagcctgaaatggactgaggacacagacatgcacagagggacgaccctgtgagggcacagagaaaagacggcatctacaagccaaggagagaggaggaaccagccctgcccacaccttgatctcagacttccagcccgtaggactatgagaaaataaattcgattgtttaagcagcccagtctatgacaccttcacatagcagccctaacaaattaacatattaaatggttacctccagcctaaagaatctggcagcatcgatatattaatatatagttttgattatgagacttaaccacagattatgtcctggagccagatatggacaaggtacattctggcgtttgcccagctacaatgcaatgctagtgaccatgagtagacaatagccatgactgacaactccaatacctttaagatgatgatcatggtttctggggaggagcccaggtggctaccatagaaggaccctattggatttgtcaagcaccaactgcaaactcagtgattatgccagccatgaaactcacattgttaccttacagtcacagtgaattaatacctatgagaaatgtgagctcacacaaagttttagaatatttactgcattataactcagaatatgaccacactgtttaaatattaggacacacagtggttttcaaaaactgatgcctactacaaatccatccaatcaacacatactcatctagtaaacacctttagatagagcctgtgctaccaagactacaatgatatctagatgactttgttgtcctcacaaagcataaagtcaagcaatagagagaaacagcatctgtaagtatatgaaaagtataacaaaatgttaacaaataccagctgctctgatttctctgtctcatctaaattgcataggaaatattgagtttctttatttttgcaggtcagctgatgccctgactcagatagcccatctcaacaagctgatgagacaaactcagttcttctccttattccatggatatgccacatatgtgaggttgttcctgcattgtgcctttttgcaacctatagggtctttcaggcattagcagttcatctgcgtttgtggtttgtacagaacagcagagtcaatttgccataggagaatcatgcagctgtttcaggttaaggaatgatagcacaagtaccttgcttgcaaatctaatagactacacctcagatgactcttccgtgcttcgcaaaacttttttaagttcaagtaaattccctttctcacaattagtgcatcccaggattatcaccctctgtttgacacccaatataattccctgtaattagttgctcattttggaaacataaaaattagaaagataatggatttcttgaattattatttttttttcaaggagagattgaaaatttctgagcctaggaatcttagtgcataaaacctttttaaatgagggaatggaaacatgatatttatatctcactgctctaaaggaaataaaaagtggggtttcttgaaaatgaaaaagggctaacaaaagtattggaagagtagatataaaaagtccactaaggtgagggaacatttgagaactagtggatgattgatgttagttgaaggtaagagagaaatgatttcttgcagtgggtaaagcagtacgcgcttgcaaggagtaatgaaaaatacatgcttgcacatggaatcaaaaaagagcccacattgccaagaaaatcctaagcaaaaggaacaaagctggaggcatcacgctacctgacttcaaactatactacaagtctacagtaaccaaaacagcatggtactggtaccaaagcagatatatagaccaatggaacagaacagaggtctcagaaatagcaccacacatctacaaccatctgatctttgaaaaacctgacgaaaacaagaaatggggaaaggattccctatttaataaatggtgctgggaaaactggctagccatatgtagaaagctgaaattggatcccttccttataccttatacaaaaattaattcaagatggattaaagacttaaatgttacacctataaccataaaaatcctagaagaaaacctaggcagtactattcaggacataggcatgggcaaagacttcatgactaaaacactaaaagcaatggcaacaaaaaccaaaatagacaaatgggatttaattaaactaaagagcttttgcacagcaacagaaactaccatcagagtgaacaagcaacctacaaaatgggagaaagtttttgcaatctacccatctgacaaagggctaatatccagaatctacgaaaaactaaaacaaatttaccagaaaaaagcaaacaaccccatcaaaatatgggcaaaggatatgaacagacacttctcaaaagaagacatctatgcagccaacagatacatgaaaaaatgctcatcatcactggtcatcagagaaatgcaaatcaaaaccacaatgagatactacctcatgccagttagaatggcaatcattaaaaagtcaggaaacaacatgctggagaggatgtggagaaataggaacacttttacactgttggtgggagtgtaaattagttcaacccttgtggaagacagtgtggtgatccctcaagtatctagaactagaattaccatttgacccagccatcccattactgggcatatacccaaaggattataaatcatgctactataaagacacatgcacacatatgtgtattgtggcactgttcacaatagcaaagacttgaaccaatccaaatgtccataagtgatagactggattaagaaaatgtggcacatatacactatgcagccataaaaaaagatgagttaatgtcctttgcagggacatggatgaagctggaaaccatcattctcagcaaactatcacaaggacagaaaaccaaacaccacatgttctcactcataggtgggaactgaacaattagatcacttggacacaggacggggaacatcacacaccggggtctgttggggggtcgggggctgggggagggatagcattaggagaaatacctaatgtaaatgacaagttaatgagtgcagcaaaccaacatggcacatgtatacctatgtatcaaacctgcacgttgtgcacatgtaccctagaacttaaagtataataaaaaaagaaaaatatgcaaaaaaatacatgcatgaaattcaataaaaaggaagttactgagagagtagatggagtagaaaaagaatggattatggaaataaaaggcaataaaacatgaaagatgggacttccattgattaaaggtgatgataactagccataaactgaggactgtcatcaattcaactgaaggctaggagtttcaaagtaaaagaatgttttatttatggcatatatatatatatgtaaatgagatacatatatctctcatttaccaatatattgtctatctatctatatctgttatctatcatctgtctaatctatctatctatatctatgcatctatctaccatctatcatccatcttctatttatctagatggaaggatggatggatggatggataaatggatcaaaaattaggcaaataaatgatagatatatatgtattgatattgagggttgtcagctctttttatctgaatactctagtcaagagaactttaaaagaatttttttaaatttggtatatgtcttaagtataccaagtgtaattgtaagttaatacaaattgctgacatctactcgttggttactctacatcggagttcaactatatgggtaggagtataaattaatattatatgtaatacatattagatatactaactcgtatctatgttctagctatctttcatttatatattcattaccaatctgtatctgtttatcacctgtatatatgtatatacatattatatagctgttgtttttctatttatcttctatttatgtagattgacagatggaaggatggatgaatagatggatgggtggatgaaaagacagagggatagatgacagagataaacataaccaattaatattgctaatgttcacaaactaagggagatgataacaaaaatgtgaagagttgccatgcagtgttaaccccgagccattgataaaattgtccactttgcccaacccactcaacttcaagaggtggggagtgacggatgttttcaaatgggagatgttgaacccagtttcccagtggtggcgtggaggtgcaggggatgacagactctcactcaatatctatttcaaaccctttcaatgtatccctccacattgctgaacctagaaaaataaaaaaaaaagtgcactcttcatttcctctacagataaagattatgcatgcaatttagacctttttccctttctttgtaaacttttttgatgacataaaacatgtattctgaaaaaggtcttagaaaaatcaaccagctttccaaataaggcaagacctatagaccaaccaccctatcaagaaatagaaaatcatcaggaccttgaagtaccccacaggggttctctgcctttccccttggagacagccttagctcatattttactgcaattgcttcctcgtgttttttttctaaacttgtatgcataagagtgaaaattttggaatttctcataaataagcttatagcttatgtgttgttttgtctctggcttctttcactgactatcacattttgagatccagccaggtgttgtaaataccttgtagtggatttactgtctctggtgtctagtattttattctatgaatataccacagtgtattgattcattccattgttggcagatatggtaattgatttcatttgcagctcctttaagccatgcagctgtgagcatttttcatcatattacttggttcacagagaatataattatgagtaaaattccgggtgctttatgtgatttagtctttgccgactggatgcaagcacctaaaattctgaaggtggaagatagactgcctctgctctttctcactggaacactcaaatacacagtggagttttattttcccatgtctcatcactccataggacagttcttagctttgtgggcattacaggggatggtgccaagcattcacttttgtttgttcagatctagcagggcagtgcagcgtatgagacaagaggtgcagtcatgagccatggaactcagagaattggattaggacatttagttgggctcatgggactctaagttcgctgaactcccaaatgcagccaatcctcaattgacccccaaaatgccctctctttccatgtgaggagctaatttttgcttgcgtacatattttgcctgatatcacttgaggtgtttgtcttgcaaaggaaggtcccttattatcataccaccagtaaaggccttccctttctccagacatatcattaaaatcagattccatcttgtcccaggaggacaagtagaaagtctcatccaggaagaaacaatgtgcatgctaacgaaataagattttgccaagtcatattgttagaaatgtgagtaatctatatgaagatggctgctaagggtgttagacacagaaataaataagcagaattaggaatcaagccaaatatattcatttgggtgcactcgagaatttgtattaaaagtgatcactccatgcataggtgaaaatatgcagtatttgtttttctgtgtctggcttatttcactttgcacaacatcttccaggttcatctttgctttgcaaatgatagcatttccttctttttaatgagtgaatagtatattcttgtgtgtgtgtgtgtaatattttctttatgcatttatctgttgatggacacttagagaagaaggtgagagatgcttctattccaatgaactcctcaaatgaagctgggataaaggaacccctgagtggccaacgccagtggaaagtgcttaaccacaagagacaacatgaccatgaatattataatatgcagtatgactagactggctgttataatggccagcctacatacagccctgacgttgtatgatgcatcaagaagggtccatggtggaataaaatggaaaacccaagaggactttacttgatctacttgaaaacagcaacaagaaaactccaggtctgctcaacagaatcctgtcttgagtcaacacaatgaacagtcatagcccctcagttaattatcacaccttgattggtttaatcttagagatacttcagtactgtttaagaggttctcttgatcaagaatccactaacactaccattaggtgtggatgacaaatcttgctgttgttcacaaaatattacatttttgatagtcatctgatgattcacagagctgtcattcatttattttcactcttgcacagcatttcttcatataaatattccgcaatatatttattcatctactgcgggtgggtgtttatgttattggaagattttaagaggctagatgtcatatatgtacaccttttacatctatttttgtttgcatatggcaggaatttctacctgtattggatcatacacatgttcagtgttactgagtaataccatctattttcaaaagacactctacaaattcacacttctgtcaaacatagatgaaggttcctgttgctgcaaattctattttattggtgttttatgatgactatgaaatatttgctttttgttgttaatttctaagttatattatcaaaatgtttgtacatacagagacatagtagaatagtgtaatggacacccacatattcatcatctagaattaacagttattaacattttgctatgtatctgcttcatcagtttatttcatcgaaatattttattttatattttattttattttattttattttaattttattttatttgaggcaaggtctttttctgtcacccaggctgcagtgaagcagcatgaccatggcttactgcagccttgacctcatgggctcaatccatccttccaactcagcctccctagtagatggaatgcaggcacatgcagccacgcccggctaactttttcaggtatttttgtagaggatgaagtctccctatgttgctcaggctggtcttgaacctgggctcaagtgatccacccaccttggcttcccaaagcactgggattataggcttgagccaccatgccagacccatgcttttttatatgtttgttttgaaatttcccctaatgacaaactaaagcaataaataaaaatgtaacatcgtaaaggcctcttacagggaaccacgaacaaggacaggaattcacaacctatgagcgataggacaatgtcatacttggacaggtggaagaaaactcttgtggttgtcaatcttgttgctgaggcttcttccagcaagtgagctatgtaagtgcttagtcacaaaggcatttcaagcaatcgaaacagaatataaaatgcatttctgattgagcattcaagagctacaggggactctgtgttctattaggagagctcacagcaccctgaccctggaggctgtagtaagagcagtcacttgttagcggagagcagttgtctgagccattggccactgaccatgatttcagctctaattacttgctcatggtgccatatcctactgccatatatggaccatacgattggtacacatcaacccagaccaatcctagagctgcaagaaatctcaacacaatagagtacaattcctgctgctgaaatggattggtacatgtgaactggtattctgagcaatgtcattcatgggaggtcacttaagatcggagttatcttttactacatgttgtgtgttcttgcaatttttgcgtgtctgtaccttatagaggatgggttcataaatggctgggctagaagggaacattccatgtcatttgggccataattacaatgttgcctaggaaactgcaccctacagaacagcaaggcatatgaaccaaatgtgtagttatgacacccttacgccctaccctgtcttgcatggaaaccttaacttgtccttaacatgggttgctccatctctactctgtggccttttgaactcaataatacctgcgagccataaagcaagagcctcatctgtcctgatatcctgctgctgttttctgttaatactactagtccatcaatacttcagaatgccaataacagcttacttaatccgaggggctggctttcatttaatatttttctacatcctttgtaatttgaaaagagatggtggcgtctacatttaccctcttctgcacgacacaacagctgtgtatattactcagtgaatattttaaatagattttttttatttgtaatttattttatttgtaattaattgattgattttattttattgagacagggtctcactctgtcacccatgctggagtgcagtggcacaatcttggctcactgcagcctccatctcctgggatcctgggatcgcttgagcgatactcccgtctcagcctctcgagtagctgggaccacaggtgtgcgacaccatgcctggctaatagttttgtattttttgtagagacgggattttgctatgctgcccaggctgatctcaagctcctgggctcaagcaaccctcccatctcagcctcctaaagtgctgggaccacaggtgtgagccaccacaccggggcaactttatttttagagcagttttaggttcacagcaaaattgagcagaaaaatgaacctacattgacacatcattatcacccaaagtccatagtttacattagagtttacccttggttttgtatattcaatggatttggacaaatgtacaataagatgtatccatcattattgtgtcatacagagtaatatcactgagagatatttatacagcataataatcactcactgatatttaactaatgaatgaaaaacaggtgactatttagatgaacttaaaactgcaaattacagctcctaatggtgagaaaaatgaagtacacatctaaatactgggaatatgtaagcacaatgaagacagccccatagtgccaacaatgtgaaaactgaaataaccttaatacacattgtatgacaatggaatattattcagccattacaaagcaggaaattctgtaatttgtgatgaacctgcaggacattatgttaaatgaaataagccaggtagagaaagacaaatactgcatgatctcacatatatgtggaatctaaaaaagttgaattaacagaaacagagagtagaatagtaggtatcaggggctggggactggggggaatgtgagatgttgatcaaagagtacaaagtttcagttaggcaggatgaatacgttctgaagatctaatgtataacatggcgacaatagttaataatactgtattctttacttgagactggataacagagtatatgttaagtgtcctcatcacaaatacacacaaagacacacacacatacactcacaataactatgggtgacaatagatgcattaattaatttgattgtagtaatcattacacaatgtatttgtatataaaatcctcatgttgtacaccaagcttgtccaacccacggcctgcaggctgcatgcggcccaggacagctttgaacccagcccaactgaaatttgtaaactttcttaaaacattgtgagactgttttctgcaattttaatttttttgtttagctcatcagctatcgttagtgttagtgtattttatgtgtggcccaagacaatttctcttcttccaatgtggcccagggaagccaaaagattggacacccctgttgtacaccttcaatatatgcaattttaatctgtcaattaaattttttaaaaaactttgtatttgggagatgttaaacttttatgtaactgaaattagatttctttcatgctttatgaactatggaatacatttgaaattgtttttaatattaattaatttcaagataattcaaggtggagacacacatacatacacacaagaattcagatttatgccgtactgcaaatagatgacttaaataaactcactgttaactctaatcaccctcctgtgcaacggaacacaagaaattatttctcctgtctaattagaactttgtatccattgatcagtaagaacattggcacacacattagttacatcattcttctgttcagatgcattttttttttgagacagtctcactccttcgcccaggctggagtgcagtggcacgatcttggctcgctgtaacctccacctcccgggtactagcgattctcctgcctcagcctcctgagtagccgggattacaggtgcccatcaccacacccggctaatttttgtatttttagtagagatggggtttcaacata[136 bp omitted]actacatgatctctctgggcaacatggcaaaactctgtctcaacaaaaaatacaaaaattagcctggagtggtggcatggccctgaggccccagctacacagggggctgaaatgggacgattgtttaagccccacaggtagaagcggcagggagctgagatcgcaccactgcactccagtctgggtgacagagcaaaaccctgtctcaaaaataagtaaataaataatagatacttcggacctagagaaaaatcttaaaccaagatgctttttgtacagattgaacccaaaaggaaaaaccttcacggcaaaatgccaaactcctgaacaccagaataatgatggagagagcatcaatccataccataatagtcactcataaaaagaccataataagtcatgttgtgggtatctgcaagtcatgttgtaatatatcactcactgatgtgatcagtcagtgagaaaactactaatgaatctttcctcattccatacattaatgtttggggaagttattactttagaatccatcagatgaatgtgtcaagtgacatccataccctaaggaggcattggtccagtggatttaatcacaaaacctgacatatccatttcactgcaggccacgtgtatggcttcatatgcaactgcattgaaattaaaattgaatgacaatatatgaagaaatttgagggcattaccagtggcaaattttcttctttatgagtataggctggagctaccataacatctattttaaagctcagagctcaaaaatataggataaaatgcacatagtaagccaataggctaatagtattaagttcgtgcaaaagttattgcggtttgttccattaaacgtaatggcaaaaagcacaatttcttttgcaccaacctaatagtaaatagtagcaggaattgttccctttagcagtttcaaataggaatagagatgaggatgtcttgatcgttctgcaacattctaaaccctatacatttagaatcatgggtttatttattttctttctccttatggcctgcatgttactgtagccatagatgagtcttcttcatttgggtttcaatcatgttttagatttctatcagttaggtttattttagatgtttcaaggtgttcccaacaaggacacttggaaggaataaataccagacaccatagggactccctgaggactttgatcatctgaggcctggatcatctctgctgccttggtggaacaaaccagttaggccagttcacgcatgacttgcatggtggtccagtaactggaaaaagcacatacatgttctctttcttggaggaagtccttaaagatgatgccatttgccctatcactaaatgttacttttttgtgattgaatcacatactagtgttaacttaaaatgtgttgcttttcaagtgcagacgagctctgagcgatgtcagtagtgtatgcaagaagatatgtgagattgttttctgaaagtggtactgggaccctagccggccactcatgttctcttgagagtttgcctgctatggccaaccacatgtagtaaatggccttagacatgcagccaaatttcttgaagcagaaaaatggggtaataaagtagcatttcataagacactcatatatgccaaatcctttgtctttttttcttttttttttttttgagacggagtctcgcgctgtctcccaggctggagtgcaatggcatggtctcggctcactgcaacctccatctggttcaagcaattcccctgcctc[219 bp omitted]tccaacaatcttatcaaatatgtttgtgatgttgccatgcctgaaatacttgaatatttcaagcaagtgcagctagtattcactttaaaaaggtttctttttcttaagttttacaggtttagggggtacaagtgcagttatgggacatggagtgattgcatagtgatgaagtctgggctgttattgtagccatcacccgaataatgtacattgaaaccattaagtaatttctcatccctcaccttcctctcactcttccacccttttgagtctccaacatctattattccactctctatgtccattgtatacattttttaactcccacttttgcgtaagaacacgtggtatttgatcttctgtttctaaattatttcaggtaagataatacatataacataatatgtaattatatataatggaaatagctatagagattctaggtgtacttgaattatgtaaaagacagtaatgctggtgtacatctatatacatcaggtttagggtgtgatacctgcataaaatgcatatatatgtgtgcgtatatggccgaaatggtgaatttaaaaaccttgtacctggagaaaaaatcttaaaccaagatgtgttttgtatagtttgtgcccaaaatgtgtaggttgagcctatatataaatatgtatgtgtgtgtatacacacaaacacacagtatatgttatatataaaacgtacataatgtatatatacacacatacatgtgaatatgtatatgtgtatatatgtataatacatgtatatgaaatatatatatatgtatattaatatatttatatatatttaatgtatacacacattatatattatatatatttattacatatattatatataatgtatagatacattatatattatataatatattaatatatttattacatatattatatataacgtatatatgcattaaatatatatattaaatatattaatatattatatataatgtatatatttcatatacatgtatgatacatatatacacatatattatatatacatattcacatgtatgtgtgattaattaaatatattaatatatttaatatattatatataatgtgtatatattatacacacatatatacacatatatacacatatatattcatatataggctcaacctacacattttgggctcaaactatacaaaaagcatcttggtttaagattttttctccaggtacaaggtttttaatatatgtatttaatatttaatgtataaatattatatatacattatattatatataacatatatacacatatacattatatatagtgaatatattataatatataatatgaatacattatatatataatacgaatatattatatacatagtccaaatatatatatgttggacattaaacaacctaaacaataattgccatgacaattgtcaatttatattttataacacctttatgttcagcacaccctttaattaatatgctttctcactttgatatttgttttctaagtatatttctagaagtaataagttttagtgatttactgcacaatatggtgactataggtcttaaaaatctattgcatacagagtgaacaggcaacctccagaatgggagaaaatttttgtgatctacccatctgacaaaggtctgatatccagaatttacaagaaacttaaacaaatttccaagaaaaaaaccaaacaaccccatcaaaaagtgggcaaagtatatgaacagatacttctcaaaagaagatatttatgcagccaacaaacatatgaaaaaaagctcagcattacagatctatctgagaaatgcaaatcaaaaccacaatgagataacatctcatgccagttagaatggcgattattaaaaagtcaggaaacaatagatgctggtgagtctggagaaataggaacgcttttacaccgttggtgggaacgttaattagttcaaccattgtggaagacagtatggtgattcctcaaggaatcacctagaaccagaaataccatttgacccagaaatcccattactgggtatataccaaaaggaatataaatcattctactataaagacacatgtacacgtatgtttattgcagcactatttgcaatggcaaagacatggaaccaatccaaatgcccatcaatgatagactggatacagaaaacgtgatacatatacaccatggaatagtatgcggccataaaaaggaatgagatcatgtgctttgcagggacatgcatgaagctggaaaccatcatcctcagcaaactaacacaggaacagaaaaccaaacactgcatgttctcactcataagtgggaggtgaacattgagaacacatggacacagggaggggaacaccacacatcaggacctgttgggggatgaggggcgaggggagggaacttagaagaccagtcaataagtgcagcaaaccaccatggcacacgtatacctatgtaactaacctgcacattctgcacatatatcccattttttatagaagaaattttaaaaagtattgcatatttcaaaattgctgagagtacattttaaatcttttgaccacaaaaataagtctgtgagaagttggatatgttaatttgctttatttatttatttatttatttatttatttatttatttatttatttttgagatagagtttcactttgtcacccaggttggagtgcaatggcatgatctcagctcactgcaacctccgcttcctgggttcaagtgattctcttgtacctcccaagtagctgggattacatgggcacactaccacacgtggctaatttgtgtgtgtgtgtgtgtgtgtgtgtgtgtgtgtgtatgtgtgtttagtagagacaagtcttcatcatgttggccaggctggtctcgaactcgacctcaagtgatctgcttgcctcagccttccaaaatgctgggattacaggcatgagccactgtgcccagcctaagttgctttctttaatcatttcacaacatatacagatatcattgtaccccacaaatactatatattattattatatgccaattaaaaattttaaaaatgagtttacatgttccaagttagtaaactaaccttatttcttacacgtagtattgtttcagatacttgtaagttatttacaacagagtttcagaaaacatttcttcataatcacaatttgaaatataatcacagacatcaattagtctcaactcactaagagcagctctgagcgatttcctaaccaccatctcctccgtataacataattctcatacgattgtttgtatccactttgttttttggatattttaaaaaatagttcacatagtttcatcatatttcatgttttactcatagaaatgctcacatgaccttcagctgtgaactgctttagattaatggccctggtatttcagttaaataaaaagttctttaattatgacatgtgtgtttctaataatctggcttaatttttgtaaaaaggcagtaagtcgtctctctttctggtgtacgctttgctcttttcttagaggaaggacatagcagaatcagagaatgccctgtaaccctgattaaaatgttattgcaccaagcaccagttcccaactactgagaaaggagcttcaccctgttcaaaaaatcttagaatagatttgagctttaattatgttattggatcacgtggcattgtcatttttgacctataaaaatggcgatttcatgaatcaaccttttatcatcctagtacatatgaataatatcatctgtcagagaaaatgtataactaatcttagcttattaaaacaaaccatgggtcctaatggcaacaaaatatcctttcaataatatttttccagcataagttttacaggtgctcctaacacccaatcccatagttaatgaacaaaaatctctctagaatgcagttctttttcctatgctttatgaatggtatggcatgaagaggatgttctaaatggttcctttataagcttttgtataagcacctttgcaatcttttgttttatcctcctgcgtggaatacatgtaaaattcacctgctaacttgcaagttaaatatttaaactctgagcacacgtggatctgtttgcgttttgttacttgctatcatgcagaacaagaatgttttagttatttataaacagccccgagacacttacaaaatagcactccgattatgttgacaatgcgtgcaatatttaatttatggcatgcactctgattattaaagtttatccatgaatgtccatagttatgcaaagtatattcatgcacatttttcttacctgtatgcaaggcatccttactagatgtgattagaaatattattttaataccttacattttggatatttaattagactctgtggttacgagagtgaacagcaagcataatagaaatgtattttggtacaaagtcaatttaattatattctaaaaataaagaaacaatgctatctactacctccataaaaacacatgaaaatatctgcaccctcgtcttcattgcaacagtattcacaataaccaagatgtggaatcaaccttagtgtccattcatggatgaatggataaagaacacgtggtatatacacatcatagaattctattaagcttttttttttttaatttcaaaaaatattgtcatttaagacaacatgaatgggccaggcacagtggcttatgcctgtaatcccagtactctgggaggccgaggcaggccttgaggtcaggagttcgagaccagcctgaccaacatggtgaaaccctgtctcaactaaaatacaaaaattagctgggcttggtggcgtgcgtctgtagtcccagctattcgggaggctgagacaggagaatcacttgaacctaggaagcggaagttgcagtgagccgagatcacaccaccgcactccagccagggtgacacagtgagactccatctcaaaaaaacaaaacaaaacaaacaaaaaagacaacataaatgaacctgggcaatgctatgttaagtcaaataaggcaggcacagaaagacaaataccgcacgatctcactcatatgggcaatctatgaaaaaatcagatgcatagaaacagaatagaacagtgcttaccagagcctgaggctggaggatggagtggcattagggacatgtcaaaggatacaaaatttctattagacaggaggaataatttcaagagatctgttgtgcaacatggtgactacagttaataacaatgtatcttatgcttaaaaattgctaacagtatggattctaaagtttctccctacacacccaaaaaaggattagcatgttgaggtggcagacatgtcacttagcttgatttagcctttccataacatatacatatattaaaacatcgtgttccacaccataaatatatgcattttttatttgtgtattggaaaattaattatttaattataaaatagcctcctggctgcactgtcttggcattgtgtctcactgatagattcacctggacatccacggtttgcaggcttccagatatgtatatgtgtgtctgtgcttatcttcgccccatgattctaaatcacaaacatgaataaagcaaaatgaaatctactcatgtcgatgaaatatggaggaagaccccccataataactttttagaatgctaagccagagctcaataccaccttttgtttttttctatgttggaagatgtggttctttgacaggaatggcaaggtttctcttcgcagaatgagaagaaaaataggtttgtccttttggtttcaggacttgtaaatgaagctgaggtgcaggagacagatgaacagacttgatatttttgttttaatcaaataacttcggatttttttttgttttcattaaaccaagtccccaaagatacagagttttgtccatatttcattaagacactggtttgatttatcacattctcaggggacatgtagagtaattatagcagaccgacactggagattttggtatttagatttgctcctcaaggtaatgagagatgagggtttcttaaaggactcctatttgtaaatgctgctctactattttcatttcttaggaccagtactgtgcctaatataaaaccagtgtctcctgtgtgtgtgcacatcaggtgcttatttttttctacagaagctagcttattggttgttttatttatttgactcttaatattcccacgtggtattgccattctgtgaccctggcctttggtttcagttctacttgtatgataaccagtgatttaagatcatgttattctgtaaataattcagtaatagtcaaggggcaatactggtattataaaatataactgagactgtataactaaatgtagccactctgttacatgcttttctaggaagtattgattctcatttgtattgaagctgtagactatatatagagagagcctagaaatatgtatatacacacagacactatagtattgtacatatatatgcaataaacatatataactactataatacatatatgtatgtaaatatatgtatataatatgtaaaagtatatatgtccatatataaatatatgaatatataaatttatatgttcatatataaatatatgaacatataaatttatatatgttcatatataaatatatgaatatataaatttatatatgttcatatatacacacatatgaatatatttatatatacaaatagataaagcatacatatttacatatatcatacataaatatatatacatgtacatatataagcatatacatgtatatgaatatatgaatttatttatacaaatagataaacatatgcatatataaatatatgaacataaatatgtgtaaatatatacaaatatacaaatataaatgtataataaacataaacatatattaaatataaatatatagaattaaacctgtacatatatgaacatacatttatatatgtatgtatgtacagatatgtttattacatatatactatactatagtacatctatatagtctgggactatatgtgtatataggctgggttatagatgtaacatatatataggtttatatatatttatataaatataggttatatatatttatataaatataggttatatatatttatatatagattatgcatatatttgtatatatagaactttaatgcaaatgaaaatctatacaacctagaaaacagtgtgacagaatggttatctcgattatatatacatttataaaatatagtaatatatggaataaacctgtctatacatatacatacatattagtatatgtccacatatgtgcatattcatatatatattcatctatatgcatatacaatcataagtatatacataaattatgcataatcaaatgatgcacttttgcatgtgtgtctaatgtctctgtctataaagatagtcatgtgcagtgagaagagagagctctttttagtggtgtgtaagtaatacttgttcatccttggagaaaatgactttacagatccataatttacactgagctcatttattaacatgagtgtggctaatggctccagtttgtcacttggaagcattgaatgccataaggtaaagtattttttcctgtagaaaacagatgcaaggtaattttgattaatgcctgaacatcagaggcagtcttaaaatccaaatgcaattgaagacaaacttcacatcctttttatttgttctaactttgtaaatcaattagcatatgtgtaaaatgaaaaactaagacaaaagaatttccaaatggctaacatatttccacataccatgttctgcaggcagtgatgccagttctacaaagacagcaccctgcctatatctagaactggcatactggtatctaactatgtggccttatttttgtactttttggagctgccttctccaaatttattttctttcatttgtgtgtttctaatacatgaaattctattatgtgtacaggaactcacctgatgatttccaaaaatttatccttaaaaatatgaaaatgaatttcttatatctttatgcatctagttttacacattcctctccattgagctgaatatttctgtcataaagcttcatttttacactctggtagttacataggtcatgggatattctccagaaatccatgtgctataaatccattgtttctaagtatttactataagccatcgtcaccagcccaggtatactttgcccatattattccatagataagggattttgcactagcaaatggcattagtatgttttccagaagctctgtctttagtgtgtttacaagaaagaaggaaaatggattgttggttagcaggtggctcttctcacccactctcttgagatgctttatatttatcctatttatatttgccctattcccctggccagttgatgaggttaaggtttgttttgttttgttttgttttgagacagagtctcacttcatcaaccaggctggagagcaatggcgcgatctcggccccctgcaacctccgcctcttgggtttcagcaattctcctgtcttagcctcccaagtagcggggattgcagatgtgcaccaccacacccggctaatttttttgtattttttagcagagacagggtttcatcacgttggccaggctggcctggaactcctggccccaagtgatccacccatctcggcctctcaaagtgctgggattacaggcagaagctactgtgcccagcctgataaggttaagtctttgaagtagcaatttattagacaaatatttttttaaaataaccaagtaaaatgatccatgaaagaaaaagaaataattgttataattgttaagaaaatgaatagagaagccacagattgggagaagacatatgtaaaccacgtttatgataaaagagacttatattctgaactcctcagaacacccaaaactcaaaaaaaaaaaatgaagacaaaccacccaatcaataataacaaatggatacatgatttgaacgacatataaccattgagaatttaccaatgcatggcaaataagcacatgaaaagatgctgaaaggccaggtgtggtggctcactcctgtaatcccagcacattgggaggccaaggtgggcagattactggagataaggagtccgagaccaacctgggcaacatggtgagacccctgtcttaaaagaaaaaaaaaattagctggatgtggtagtgcacacttctggtctcagctacttgagaggctgagttgggaggatcacttgagcccagaaaaggaaggttgcagtgagccgagatcatgccactgcactccagcctgggtggcaaggcaagactctgtctcaaatatatatatatatatatatgtcaaatatatatatcaaatatatatatgtcaaatatatatatcaaatatatatatatcaaatatatatatcaaatatatatcaaatatatatcatatatatcaaatatatatcaaatatatatcatatatatcaaatatatatcatatatatcaaatatatatatcaaatatatatcatatatatcaaatatatatatcaaatatatacatcaaatatatatatcaaatatgactgattttgaatatatattcaaaatcattagtaactgaaacatgcaaaataaaatgagataccagtacacagatatccgaatgcttcaaagcaacagcaacaataaaaaaatcccttcaatctgactatattaagtgctggcacagatgagaactgaagctctcatacatggctatgagaattggaataataacctgacaggcttttttaataaatgtaaagttgagcatattcttagcatttgagctgccaatcccagtcttagatgtttaacttaaagaaataatggtttatgctcaaacaaaaatgattgtttacgtgaatacaggtttattcataactgcaaaactgaaagcaatgtaaattttcaactggcaaacatacaattaggttgtggcacaatcatacattgagatatttctcaacaatttaaaaacaaacaaagaaaacactgacacttaactagtggtttaccagcagtgcaataactagtgcacgcagagacctagacaaatcaccagtgctttattcagggtaatggaagtcagactccaatgtctacatatactttaattccctctacatgactttctggaacagccaatgctgtagggataaaaatttgtttcatgtttgccagggaatgtgggttgggagaaagtttgagtacaaagaggcacaggggaacattttgggatgataaaactgtttccatatcatgactatggtaatagttaccatcaaagagtacaaaccccagaagcatgcaccaaaaaaataaatgtaactacatagaaaatatacggatatataaaaatatacaaaacatacactgataaacctaacttaaagaaataagaataaccaaaaatagagaattctgcttgcaaattaatccttattttccccaaatgccttttatcaaaatagcaattacttaagaaatagcaatgtttctaacttcccaacaatctctgatgatcatgtttcagcaaaacaatttttggggtaataaatgaggcatctaattatactatagattaagattctattaataataacaggcgcattattctacctgtttactttttctaaactggcttaaagaaatcaaggatcagaagctgttatgatccttataacagtgaggtggaggaactgttcgaagtgggatggactacaatgaaatatagggcttagcaaaaacttttctaaggtatattattaagttttggttttcacaccacataaacattctatatgttaataaaattaaatcaaacaggttacaaaactacacttataaacaataccaacaataaaagaagtctaactttacatcaaattgatagcaatattgagtattatgttagtaagaaaataagttgctaaagttaacacaaatagatataatgatgttattagaaactaaggtttttggtataagaaaaaacagattcaaatacaaaatagtaaaataatttgattgtgagaatccttaaacagtgtataaatatatcaaattatattttacaccttgaatatttccaatatttgtcaatcacatattttaaaatgaaaaatttttaaaatacaatgctgaaatttaagtaacaatatgaatataaactcacaatttcttaaagaaaaggtgtactataactcagtgcagtagtaaggtctataacctatgacgtcagtgccggaatgaaacaattctcagatcctgatttctaattattggtgttattaaaaaggaatcaaggctccttgggaacatagctgatttcatggggttgagagactgtgagttgagctaagaatatcctattgtgtgccccaaagaaaggaagagctgaacaatgaatttagaatgtgtcaaaaggacccagtaatacatttgtttttctccttcctttttgatgcaaatgttaactgctgtggtaatagatcagtttcacaacagatggtaatgatgctatggtgaaaatatatcactttcacatatgtatatatattgagtataaggtgtttcaacatttgatacagtaagtgatacacggggaacttccttcgtgtaaccaacactatgatcttgttagatactttgtatctgcgctattctgccataggattatacctattattcatgagtacaattcatattatggggaaagagggaagtctgaaatgagaaatggcccatttgtctagatgtctgagtcttagtggattttaataattcttgcaccgccaactagtctctcctttgccttctcaactgccttctcaatcagtatcactgggattcattttgccttctgcataaagtaaacaagagtaacctgcaagaatgcatttgataaaaggaaaattttatccacggtttgagtttcacctgtagcacacaattcaagtgtgaaagaagtgatattcagaccctgagatctttagttttagtaaagtttatttgttttttaaagtggatctcctgcttggaaaagtacagtagatgttcagcaagatagtttttacttaaataaaaatcatagcaatgttttgaaaatattgtagaaaatcttacttttttttgttttgtttgttttgagacagagtctcactctgttgcccaggccggagtgcagtggtgcaatctcggctcactgcaatctccacctcccaggttcaagggattctcctgtctcagcctcccgagtagctgggattatggggcgtgccaccacgcccagctaattttttgtatttttagtaaagacagggtttcagtgtgttagccaggatgatctcaatctcctcacctcatgatctgcccgcctcggccacccacagtactgggattacaggtttgtgccactgggcccagcctacacagtttaaataagcaattatatgttttttgtgcttataataattgtataatttaggtataattataaggagtcattcattttctaatattttctgcttcaaattcagtgtattaacttaggtaaaaaatgttcaatgatgcatgaacattttgggaaatgtggccaagaaaatgaccatacactaccatatgatccagcaatcttacttttggctctgtatccgaagaatatgaaattggtatgtcaaattgtgcaataaccccaaatttaaatatcctttcctggttactacataacacattaaaacaatataatattaataatatttgtaatataatgtttcatgttgaatattatcacagttccccaatttttatggtttataattttacaaaacaactcagttttccaatcatttcttttccatgtggaaaactatgtctaattaactattatctttttaataccacctatcacttacatttcagaattgcatccacattttcaggcaatgtctttgtctttggtagagaagaagattgtttgtcccctgtttgagtggctatgtgaagtgttttgaggttagcaaacctgtcttcccttagaaccatttcacacatttgagaaatatcattataacatgtcttcaaaactgggaaagaaaactcagctgtgttcaacaaatatttactttcttctttccaaaaatcagactgcagaaatcgtacatagtataggggatatttgatcacttcatcttggaggtctatcacaaatataaatgtttctatcatagcattatttatgtttatataagaaaaatatttatttctaatttttattttctggtatataatgcagaatatgaaatttggaaatatagaagggagggaacaaaatttaaatcacgtatattttgttttatttcttttagcatttttttatatttgtgtgttttataaaattaagaataagatacacaagcatatgcattcatatagtgtatttcattcaagataatattgaaattatttttcatttcattatttttattgtttttttgaattaataggccaatataacagaatagaatattaatcatttttaaagggttattgtatacctgcctagattccttactgagaatattgtatctttaatgatgtatctcatattggaaaagccatatttcctttttcctatttgaccttttcatgtgataatctttgcatacacatctttctagataattttgatagttctttacaatagattccagtaaatgaaattattgtgagaaaatgtaggattgtgagatcgctggttcaggctgttaatttttttccaaaaagaaaaaaatggtaataatattgccaccagtattgaatacgaatgtcttgttgacccgtcttttaatcatttttttgttggttttgttttgttgttgttgttgtttttgagaaggagtattgctctgtcgcccaggctggagtgcaatggtgcgatatcggctcactgcaacctctgcctccctgcttcaagcgattctcctgcctcagtctcccgagtagctgggattacaggcgtctgccaccacgcctggctaatttttgcatttttagtagagacagggttttgccacgttgaccaggctggtcttgaactcctgacctcaggtgatccgcccatctcagcctcccaaactgctgggattacaggtgtgagccaccatgtccagccaccattttttttttttttttttttagaaggagtctcactctgtcgcccaggcaggagtgcagtgatgtgatattggctcactgcaacctccacctcccaggttcaagagatcctcccacctcatcctcccaagtagctgggattacaggtgtgtgccaccattcctggctaatttttgcatttttagtagagacgagcttcaccatgttggctaggctggtcttgaactcctgatctcaagtgatccacctgcttcggcctcctaaagtgctgggattactggcatgagccactgtgctcggcccattgtgttgtctttaaaaaacaataatgttatgataaagacttctatctaattattaatagtgcatttatgactagatgtaaagataaacatcgtttttggtatgtgtatttttagccctgcataaaatatttatctccattaaaacaatcaggacaaggattttgctctatatttaaaatttaatttttgtcatatttttatgttgataagtacgtctctttgttccaccacgagcttcagctacatacgaaacctctcgtgaatatccttgtcagaactctcccatgctctttaacttaagagtactgaaagccacatttttttcaatgctgcctatctgggaatatctaatactctaatctaggccgggcactttttgcatgcctcaaaatctcccttgaatggagtgtaatgaactgaacaattttatatagcagtgttgagtcaggcattgatgagtgaagctgacatcctctctcccctaattttcaattccacatcttttggatattcttcaccacgctcaggtttgctataggtggatggagtgatggttcagccccgctttgtcccagtcaaatagttcactgctgttgaatgtccccagtggttcgaatttccttgtgtatattttagtcgtgtatggtcagtacttagctgtgaattggtttacccaaacccatccacctattcaggtcaaaagccacactgctatagcttttcggggagaacaggaaagaaaatctcatctgtggtcatcaccagcttttcacttttttattttttattttttttggtacagagtttcgctcctgttgcccaggctggagtgcaatggcatgatctaggctcactgcaacctccaccccccaggttcaagcgattctcttgcctcagcctcccgagctgggattacaggcatgcaccaccatgtctggctaattttgtattttttagcagagacagggattctccatgttggccaggctggtctcaaactcctgatctcaggtgatccaccagccttggcctccaaagtgctagtattacaggcatgaagcttttctactttcatggcactgcctggaccccagcctcctgccccagaagccctttcctatcctgcatattatctctatttctacgcaatccccctctgccatcacaaatattagataagctatcagctctctttgacactgagctaaaatctttgaattttatctcaaagatttggaggtaacatggaagagtttcaatcagagaatgacatgagggggttttggccttagaacattcattctggctgcggagtgtcaaataaattgaagatgagcaaagagacaaagaaatcagtgagacgtctacttaggaaaactctgaagaaaaaagagttatgaaaatgatgaaggaaaaaatatggatagactataatgtgctggaggaggtatcactaaaaggcactgagaagagattagggagagaagaagatcgtctctgattacaaccaattgtgtagctgaagtggtggttggcgataaaattgtttatttgcttacttatttattcagctttcttgagagagaattgacaaattgaacgtgcatgtatttaggatggacaacatgatgttttgatataaggataccttgtataatggtttccacaatcacactaattaacatatgcatcatcccaaatagttaccactgtatatctgtgcgtgtgtgtgtgtgtgtgtttgaacacttaagatctacactaccatgtgatccagcaatcttacttctggctctatatccaaagaatatgaaattggtatgtcaaagagatgcctgcactctcatatgtattatagcattattcacactagccaaaatatggaaacaaactaaatgcctctaaatggatgaatggataaagaaaacgtggtctataaaaacacattggcatcacacatctcggggttttgcatcctaaccaactgcagatggaaaatatttttaaaaaaaattaaaaataaaaatacaacaattaaaataatacaaattaaaaaatatagtagaacaagtatttctgtcgaatttacattatattaagtagtataaataatccagaattggtataaaatatacaggaggatgtgcgtaggttacatacaaatactacagtattttatttatatcagggacctgagcttctgcagattttggtatccgtggtgggttgtggtgggaggaagtcctgcaaccaatcacctgtggttactaatggacaactgtatatgtgtgtgtgtgtgtaacagaatattatttttaaaaagaaggaaattctgccatttgtgactgtatgaatggaggtggagggcattatgctaagcaaaataagcaacatccagaaagagaaataccacatgatttcacttgtatgtggaattttaataagtgaaagctattgctttagaagaatagaatggtcattaccgtgggctgggggaagaggaaatgggtgatgtttgtcaagggtacaaacttttagttacacgagatgattacattcagatccaatgtacagcatggcgactacagttaataatactgcattatgtacttgattttactaagacagtagatcttaagaggtgagggtattaattaaaacagggaacactggctggctgtagaacaaatgatggaccatgtggatgataaactcagctttagacatatgaggttaacgtctcttgtgatataccacaagattgtcctgatgggttaggacaggaattgaattttataatcatgggcttgggagacagatctgccagtgatatcagctgaggagccaccaccagcatggagatgagaaatgaaaaaaactcattggcaagaagactaagacaagacacactccaaacttcctgatcaaaatagaaatgtggatgtgagttccctccttctggcatgctcattgtgatggttaatattgactatcaacttgattggattgaaggaggcaaagcattcttcctgggtgtgtctgtgagggtgttgccaaaggagattaacatttgagtcagtggactgggaaaggcagacccacactcaagctgggtgggccccatctaatcagctgctagcctggctaggataaaaacagacagaagaatatggaaggattagactggctgagtcttccagcctccatctttctcccttgctggatgcttcctgcccgtgaacatcagacttcaagttcttcagctgtcagactctcggacttacaccagtggtttgccaggggctcttgggccttcggcaatagacagaaggctgcactgtcaaattccctacttttgaggttttgggactcagactggcttccttgcttctcagcttgcagacggcctattatgagacttcagcttgtgatcatgtgaatcagtacttcttaataaactccccttcatatatacatctgtctgattagttctggccctctggaaaaccctgactaatacgttcatcttatgttaacactgccgtcaccatttcttttctatctctccgctgtcccctctcttctcttgatcaaccccttctctccctcccccctcctctatctccgactctctcctctctctaccctctctctctctcctctttctcctcttttttctgtctcatatatatatattttatatatatatattttttatgtacatacacaaatatatatgtgtgtgtatatatatgtgtgtgtatgccatattgacacattctatttgtttttttaacagaaggagggtgtaacttagtaggaacaacagagcctttagagacaaacacatttggatcaaaatctctgatcaaaacccaagactacacaggatgttaaacaaccaggaacagtacaaagtgtcctcttccttttctcaatcattgaacaaattcagtggaaagaggaagagggtggagtcagggtgttgtggatttgtttcccactggtacaattgcttgcatgaccttgggcgtgtcattctattatttaacagattcccatttcctatctgtaaaaagggaagaataagattttcaaatggtatttacgaaaaataaattagattacttacatgagcagaaaggagaggacgaatactgcctaatgcttcaactgatgctacaacagggaggagaggacagctcctttcaaagaaaaaaataataatttgatgatatatttagatagtaccatggacttggtctgcagtgcaatggaaaaggaaaatagctaaaatgcagagtataactttccactcatagatgtaatcaatattaatacccttgttgtgtggatatgttatataaagccaagcccttcccaatatcccccaaaaagtcttgggtcaaccatatttatggcaaggaaagacacatgacttgttgaaaagaaacaattttggcaagtgataaaatggtttaatcaagacgagacacaaagaattagataatatttataaatgaggtagtaaaagaggtagaaaacaacccaaaattccaaatacatgtcactttttctgactagagaatccctgagacattgcaggacatagtgggtatttgagacaaatttaattagtgtaattttacatctcaaaggcaatagtattccaggctggatgagatgggcgatctctagtaatttatacatctgagatgatctggcatattctagatcctcaattaataacatcactgctgttttaatagtggtaagactagtcattgatgttattgtaaatactattagaataccattcacacatagtctataaagggggaactcttcagttttttcaattttgctttcttacgttgtttttctgttgtattgtctgtttctgactttctggcactttcagaagaattaccagccaatctcaacttataataaggatacagtatatgtgttccagtatatgtgatacagttacctctggcctaaaaaatttcaatcagaaacatatgttatgcataaagtaattggtgccatctgaacacccttctaagcaaacttatttgactttttgtagtgttgatgtctcctggtacttaaccatttcattttgagatgttagttataatggtattctatagagagttcagcattgcaatggttaattttatgcatcaacttgactggactacgggtgcccagatagctggttaaatattatctctgggtgtgcctgtgagggtgagggtgtttccacaaggaatccacatttaaattagtcaactcaaaaaatatttttccctccccagtgtcagtgtgcctcatttaattccttaaaggactgaatagaacacaaagtggaagaagtttgaattaactctgcctgactatttgagctggaacatttatcttctgtcctctgtgctcctggttctcagatcttcagaggagactggaatctgcaccatcgtcctctgtttctttggtctttggactacaccactggctttcctgggtctttatcctggagacaggtggttatggcacttctcagcctccataatcaaatgagccaattctttatcataaatatttttgagagagagagtcttgctttgtcacccaggctgaagtgcagttgtatgatcttggctcactgtaacctctgcctcctgggctcaggcgatcctccaccttagccccccaagtagctgggaccacaggcatgcaccaccacacctggctaagttttgtatttttagtagagacagagtttcaccatgttggccagactggtctcgaactcctgacctcaggtgatctgcccgcctcagcctcccaaagtgctgggattacaggtgcgagccactgctcttggccccttataatatatatgttaatagatagataaatatagagtttttttagttatatctatatgtataggtatatatctgtatcttattggttctgtttctctagagaacactcacaaatacaaacatttatactgtaacctttgagaagttactttatgtctttcagcgtcagtttcccaacatgcagaatggaaatcacaactttgtcaacaacataaagtcactgtaaaccttaaagtgataacaaatgcaaagcaagatatttctatacgaaggacgaagattcaggatgatatttgcattacagaaggaaaaatgtcctaaacccttagagatatatttcaatgactgcattttaaagtaacacatttcacgtcctcccacctgctccaactggatgtgttaagtggggaatgtttgaataatttttgctgattcagcaggtaaagtagaacattggctctttgacaactttgcttattattaagtagaaaggaggagtttaaaatacttgcctgtaaagcctctctcaagaaatccccaggccagactgattaactcagaatctctaagaatggacctgagatgtctgtattttgtaaaattccctcaagggattcttatgtacaggcagggttgagattcactaattagaggtttggatatatgaaaattaaaaccaaacttaactctggagttcgctggcataaatctgctgtatagaaaaagtatttgaatccctattatgtacaagtcaaattttctgactcagatcaaacactaaattggtgatgaagaaaaaaaatgtcctcaacactagaaaataaaattcacccatcggatgctgttgtaaattctgaaactttagaattattgaactgtcaagagacccaggaggaaagaaatatgacatatgttcagccctagaagggaaaaatttgtgacattttccaggtttaggccattaaaaaaaattgtgagagaaggtttctagagtatagtccaggtggcacagtggttggtggatttattaatgtggcaggaaatacttttcgaacatcattacattccatagggttgtcagtgtttattaagaggaaaaagtgtctagaagttcctttgacactattaatggttaagttcttagcagccataattaaattccaacataaatcttatgattaatctaaaaaacagaagatttaaggggaaaaatcacctaaaaataattttgatatatcgcacaaagtgagatatattttaataactcacaaagtgagttccaacataatattttagggctctagagcatgcatttccaaatcagatttccattaaattagcatgctctttgtgaaaatacttcacatgtatcatctaaaattgaccaaagtctgttgaaattacttttagtattctgagttcatgaagagaatgcagaactaagtcaattctttttttatcaagattataatgctggtcacatccaacatgagtttatatgcttaggaagggtggttgagggagattttcttcctcagccacggaaagtaagtaatttcatttaatccaattagattttgtaggttttatcattttttctcaaatcttagatctggaaagaaataaatgctttaagaaattgatattctgcatggaattgatagcaaatgcatatacgcaaggcaatccacagtgtgcaccccattcttgttcctggctacctaagggttcaaagttcaacaaccaatacctggcatacagttttgcttatttatgtgtgtcctgttttattccaaaagtgttgaaagtaatgggctaatataacaagtcaagcattatcgtagtgttggaaaacaagtgtagaaaaaagtagattctgtccttgtcccaaacttgataaaaaatgtactccccataaaatagcaagtagaaaagaactctactgaaagttgggggaatctgggagccactctgacttagcttttacagttttcatttctatttggtcttattttaactaagcgaagggaagccttaacagccttcactttttgcacctctaattaagaaaatactttagaagtataatgaacaaagtgggtctagcatcagtaagtcttcagtgtaaatttcagatccactgttcaggatctgaaaagaaaaatgagcatggctacgcttcctaagtatgtatgcgttgtgtataaaatgggggatttgagtaataacttttgctttagattttatttcaggttttatgtagcaggataatgtcaaatgtttactttatctctaatgcatagcagacatttttttaaatggctggtttaaaaaatctaactatactcctctttttaaaatttagtagcagctgcaattagctaaataaatatatctctagaagaaaactccagatattccagaaaagtattttttatattgtaatgcatatatggtcaactgtcaacactttattaaactcagtcctaattaacttatttcttagttgcattgcatacatgtctttaaaaagccaccacgattttattattattttttttcaagacagggtctcactctgttgcctaggctggagtgcagtggcgcgatctctgctcactgcaacctctaccttccaggctcaagccatcctcccacctcagcccccaagtagctgggactacaggcccacaccagcacgcctggctaatttttgtatttttttagtagagtcgacgcttcaccat[131 bp omitted]agcatttataaaccagactgattcaaatgttgcagagacaggttgtcaactgctttaaataacccatggtgttacctaagaaaagagcagaagtgtgcacaaagatatatggatgcctaggaactggacaccaagaaggaatctgctacttctgcaaagataaatatttgggttggtaaaggattgagtccagctggcgttctccaggctcccttctctcctgctgtctgacccaactgctgtctgagccaactgtggctcctccagcattcacgctgttgctgcttctagtctgtgtactgaacaaattgaaagataaatgacatatgaagaaaccaggagctgctgaaccactggcatcctttcagagttctgggaccatccaaggctttggataagaccagcacagtttgatcttgactcttctcagtgtgttttagttgtctgccgtaacctgagtcaggatggaggacttctgggagaacagataatgtccttgaccaatatcttcgaagagaactgtggacgcatttgcagcacgtatcttagaggggcaatttggcaacactgagtccagaacaggtttgtgcaggaatcactgaaattagtaataggctcttaaatattaacaacccctgaaaacaactccaggtgggagaaaagagagaggcacttctgagaccaattttctacttcggaagaggccaggcttgcaaaatggaattctggtttcataacagaagacatcttattaaagtacatgagggtgagtctgttgtggtctgcaggtgttgcctggcagggtttccaatacctaccgtagctgcacatgttttgatgaaaaatcagccaacattttcaggcaagtggcacagatgtctcacctccgaaaggtctaggaggaattgtcaatcacaatcccccgtcttcattgcgtctttctaataatagctataaagaaatcttccaaaaagtcatctttgttagaaatctatggtatgcatttaaagaaaaagggtcagattaagatatttaaatataaatgcatatggaatttgctgaaaggcagacttgtgatttgttgcctctttgatgctcatcttcaaggtggagacaagagttggaggcagctcgtttttttttttttttgtattatactttaagttttagggtacatgtgcacaacgtgcaggttagttacatatgtatacatgtgccatgttggtgagctgcacccattaactcgtcgtttaacttttccttgattaaaaccattagcactgcctcacatgacggtcttcaccctctctgaggctgacctgctctcacgctgacaacacccagttcctttgcagatctggtgatcaaacccagccttccttcttgctttcagagatgaagggcacatttcacttctaaaatttctcattattatttggagatattaaaaggcaaggggcacatttgaacagagcttggataatgtgatctttatcatttaatctaggatgttttacagacttaactagcatctgaagctcaaaatagacactcaatggcaaaagaaatggagtccaagaaagagatttgttggtgaccttaaataattaaaaataaataaataaattggcctttggctttggttggagatgatttattcatgaatgatgtttttacacccagccttaaatgcgaacaatacaaatatgagatgacttcgatgtcgttttggggaatttccatttgaagttcagctgtgggtcattgagagttcagacaacctcctcaaaattgaattccaggctaatgcaggggtccaaacccattttccatttcaggagataaatatttgatggataaattccttcaaagctctttgggtcaggaaaaaagtgcacgtagagcagaataaattggcaaagcaggcctggttcagatgaagaaagcatgttccacactaagtctgcctctgattacaactcaaagcttgaacagaacatacaagacaattacaagtagattccaagaagtagagtaaccagcagattagagaggaaaatcagaactcaaagaatgaccaaagagcagtgggctctgcatagagtgcccttgacataagtgactccatcttagagaaaggctcaatcttacatttcaaaagttgccttgccaacggggaccagatgtcttgcctaatcaataaagactgcacccaaccagataaggacataaccaagcacactcttccactatcagtcttcaccagaggactctgtggccataaaaacagcagtacttcagcactgaagtacttgaaatggttgtcttaacaggcaccatcttgctgtcacttgtaataagcacctgacgtctgctagcaaaggctctggccatattaaaatttcttccttgcaagacagatggactgagcaggccataccaggatcttctttttgtctatattattctccctggactggtttgcttaactatttttcctatctctttactcttgatgttgaatgttacattgtttgttgtggagtgcttaatctataatattttatgtattggttaagtatgataatatgtatggttttacagtattgactgacttgtggagtgacttgagcctctgtgcctgcagctctgaccactgagtgaacaagaaatactaaggagaattccctccttggaaactccatgtggcttgtggcttttgcattgaaatagcatcaatacatgtgaccttatagaaagacacaaacatgcatggactgggttatctctgaccttgcattgctcatgatagtccctctctttttttccctcccgtctctcctgactcagacctgtggcaaacttgacctttaaaactctgctgcagacatggacagacaaagaaccaagaaaaaacctctctataaacctctttattgagttggaattccagaaagtgggtaccctgcagggaatagcctattgatctctcctatcctccttccacaggatgttttacatctatgtggtggctgaattaatattagacaaaatactttcagaataaaattaccatggatgaaagtggacattacataatgataaaatgaataatttgtaacttatttttttaataaagacagatggattagatcatatttccacaataaaatggaacagagcctcatgatatttccctctataaacttaatgttttaaaagatttttacaaatattttatattgaaacaacattttcctattttacatctataaaagaaaattgcttatcagtttctgatcggcatgaaataatgattgttataacagtgaaatgatgtaattcatagtctaaagaaattttccattttatttggtctgcaaatttgttttccatgtaaaatgtgattcctgctagacttttgtaatttaataagaaaccatggctttctaatactaatttcagagactttatgagatgtgtgacccaaaggtgcaaaacactgggcattttttgtcttaaggttcctgtattacagactagcagatttcatgtaagtcagtcaaattttgataacgatacgagtgctaggttattaataattattattctaaaattcatctcaaattctccaccacctttaaaaggtggtggcagaagagacaagtgatcatcatttctttcaagcaaattctcaagaatgaccagaccgggtctgtaatgtctgaaaaacacagtgagaacataaaaatcaatgttctcaaaagaaactaaatgagaaacttacacgtctatatggaaatgataaaaatgagttttccattaagaactcttagcttacagtgaactaaatgcaaattcaagaaaacaggagttgcctttattctaatactatgttttgttaacaaggctattctctcttgaattttagtaaaaatatttgcattatgaaattctaacaaagaagaccatatgggcattttttatgtactgaataaggaaaacagaagtctatttctttgtcttatttctgatttttaataattatacttttctgcataatcaaaaatttgaataaatattgccttaatcacaaatggaattcactaggttcaaagtatctttgcttctgtaataaaaaccattcatattttgtctgcagaattgctttatattataaatggtccctgacttaatgatggtttgacttatgatgactttacggtggtgcaaaagtgatatgcatttactagaaaacctactgccaattttgaattttgctcttttttctgggctaatgatacgcaatgcaatgctctcttgtgacactgtgcagcagtggtgatctgcagctctcagtgtgccatgcgatcggagggtgaacaaccaacactgtctctgcagtgttccatatccaataaattatgtaagatagtcaacatcttcttgcaaaaaattctttgcattagatgatttcacataactgtagcccaaagtaagtgttctgagcacatttaaggtaggctaagctaagctatgatagattggttgtattaaatgcatttttgaattatgatattttcaaactacaatggatttattgggacataaccccattttaagttaaggagcatgtgtgattgaagatcctctcttgctcagaactctacattcccataataacgttggtcaagccagggatgtgttgtgtgtgtgtgtgtgtgtgtgtgtttctgtctgtatgttgttggtgaaagattaataaatcaaatttatttaaatgtattatactagaggctttgtataaaattgtgtaatttaaatatttaaatatctcatatatcattaacttaaatttgtataaaaatatactcatttttaaaatttgaccttaatataactgaatcttgtttttctttttgacatctttcttaaaataaacttgctattgatgtaattttagtctaatagcgtgatctcttagaaatcagccaggcacagaacgacaaacaccatatgttttcatttatatatgagagttaaaaaagtggatctcatgaagatgatgaaggtaggtagtagtatggtggttaccagaagctgtgaagagaagttgcgtaagagatatgaaaatacagttagaagaaataacttcttataattgacagtacagtagggaaattatagttaacaataatttattgtaagtttcaaaataactatgggggaaattataatgcttccaatacaaagaaaaaagaaatgcttaaggtaatggatatcccaatttccctgatttgatcattacaccttgcatataggtatcaaaacaacattttatgtaccaccacaatatgtacaactattgtatacaatacaaaagcaaaagtaaaaaataagaaagaaaacatcagataaaattgacaaatgaaatgcatgcttttttcaacttgagaatacatttacaaatgtttttatattttaaattataaaaattagtattattaatttatattttaagtaattaatatgtaatctcacttagaataaatgttggcagtagttccctagctggaatgtagcactgtgattttggttgtttgagaagaaacatgaagcagatgtgttaacttaattctgggtcatgtctttgggtcacacagctgcaccatgctttaataaataagaaacaagtgctcacctattaacctttcagctgaaagagatgactgatagtgggctcatggaacagattttagagactataaaaaaatacaaatatccctgtgaaaattatcctttcataggatcatcttagctggattttacgtagtagaagagatgttataatttgtgatttttatctctggctcaaatgcatgccttcattctcagtaatccactgtgggggctttggagaaggacagatctgggcttgaaaccaggctcagccacttactagctacgtgactttggacaaatgacttaattctgtaaagcctctacaagatatctaaagattagaatctaaagaatctacaagattctacaagatgagtgctaagttcctggtacaaggtagcactgatcactaataataattagttatattatttttatttttatttatttattttttttgagacaaagtctcactttgcaacccaggctgggctgcagtggcacgatcttggctcactgcaacctccacctcccgggtcaagtgattctcctgcctcagccttccaagtagctgggattacaggcacatgcaaccacgcccggctaatttatatgtttttagtagagatggtatttttgccatgctggccaggctgatctccaactcttgacctcaagtgatctgtctgcctcagcctcccaaagtgctgggattacaggtgtgagccaccggccccggccataattagtattcttgttgtcattatttcacaaacgatatccagctcttcttactccctcatcacaaagctatgcggacacatataaaggtactttgggaccccggggcatcatcagaaaatatattaaaaataaaccaattaatcattcatgcattgtttcaataacaacaaaaattttgtaaaactccttcactattttccctactaatgtaagctccatcactttgtcttctatccaaatagtataacccatttctctctctcagaagatcattttcccttttggtaattttctggcatggctttatattcatgatagcaatatctgctttatttaaacccccactttccttgattttatatcattggaatgcactattcagcaaagcctgaagaactttgactatctctttcacgttgccagtggcatacagacagtatgtatttccaatcaccttgttgaataggccctaaagtaggctctctatgcttgtgtgtagatcagctggaaatactaaaaaagaattgatgcaaatacaatctcttgcattatacctctccagggtgagtgtaaacatgcaactcctacagatttcagtattaacgaaggccacaaaaacacttagaaatagtcataatgatagcagaaataatgttgtatgctttatttttacgctttacaaatagtctcaaatttggtaacctatttgatttccatctatttatttgaattaggattattatgacattttcttctgatgagaaagataaggcacagagtttgactatttgctagaggtaactcaacaaataaaggtaggattggaaatgacaactttgtccttaacttcaaaacccacaagatgcacttcacagcaagtggaatctcaagcaattaaaagcaggaagttaagaaataacatgggttgtccttttcttttaatcaccaataagtagggctacatacccagcctaagaatgattttgttttcttcctctttaagctgatgaagccctattacatttatcagcagcaatagcatcccagatcttactgcataaattctgcacgactgtaaaactgaagaaattcacagtcacctagttagttgctacttttgcttcctttcattgattagtttgcttttgagtttgcttccatgcttattagttaatgaattgacttctgtgccacatcattcacatgtatagaataccaatcctactgtataaggaactgggaacctgcctcccactggatattttaggctatgtaattttatttaaagaagcagtttttgaaaaattctgggcaccagcgacggctttacttcagagcactgacctacgctcactggctaatggatatcactggccttgagaacaagcttcagcctctaatatggcttaactgaaatttggggcataaaataagaaaaatacaacttccaaatgcagctgccttcgagattcagttgctcccagggcccagatatcctgggctcaagctgtctcctatggggctgccatttcttgcagactcatctcaggctgaggcattgccaggtgtgatggttaatacgaagtgtcaacttgattggattaaaggatgcaaagtgttgtttctgggtgtatctgggtgtttctgggtgttgccagaagagatttgagtcagatgaccaggaaaggaaaacccaccctcaggaagacccacccacaatgtgggtgggcacaatccagttggatacccgcacggctagaaaaaacaggcagaaggtggaagaagctgacttgctgaatcttccagccttcatctttctcccatcctggatgcttgctgcccttgaatatcagactccaagtttggcttttggactgttggacttacaccagtggtttgccaggggctctcgggcctttggccacagactgaaggctgcactgtctatcggcttccctactttggaggttttgcgactgggacggagccactactggcttccttgctcctcagcttgcagactacctgttgtgggacttggccttgtgatcatgtgagtcaattctccctagtaaactccctttcatatatacatatatcccattagtttcttccctctagagaacatttactaatacaccaggtatagttatgagttgaattgtgtctccctcaaatttatacattgtagtgggggttaggactgaagaggaagacccaccctcaggaagacccagccacaatgttctaatgccctttggtatctgtttctgtgttagtttgctaaggataacagcttccaactccatccatgtttctgcaaaggacatgatctcattcctttttatggctgcatagtattccatggtgtatatgtaccacattttctttatccagtctatcattgatgggcatttaggttgattccatgtctttgctatgtgaactgtgtgtcaatgaacatatgtgtgcatgtatctttataatagaatgatttacatatatgtcaaaaggggactttgcagatgtgtttaattgaatatgttgaggtggagagactatcttgaattatccaggtaaactcaatgtaatcatgaaagcccttacaggagtcagagagaaatctgaattggctatgctgctggctttaaatgcaagcagcctctagaagttgaaaaagaaaatgaattccttcctagagcctccagaaggaacaagtcctaccaaatctttgagtatagcccaaaaagactggctttagacttctagcctcaagcactgtaagataaaacaatgttcttttgagctaccaaatttatgattatttgttacttcagcaacaggaaacatattaatttacatgacagcaactgaactacgtctttccctccacagggggaagaacctcttttcctttccccatgatatatttttcaatgtaaaacagaaatgaatcaaagccacttctgtttatgaaaaatctactctgctcctttctgcacatttcactggtgattattctgagagttaaaagtttgaacccaaaagtatctgagacaggactcaatcaatttagaaagtttattttccaaggttaagcacgtgcctgtgacatagcttcaggaggtctcgatgacgtgtgcccaaggtgatcagagtaaaccctccatttatatattttatggagatataatatatctaccaagacatgtaaggtgtatgttggttcgatctggaaaggtgggagtgcttgaagcagaggctttcaggtcataggtagatttaaagattttctgattgtcaattggttgcaacagttattatctaaagacctgaaatcaatagaaaggaatatctgagttatgataaggggttgtggagcaaggttttaccatgcagatgaagcctccgggtagcaggcttcagagagaatacattgtaaatgtttcttatcagacttaccatccgtgtttaagtgaatgctggttggcttttccagaattccaaaaggaaggaggatataatgagccatgtttgatcccactccccataatgacctgaactagttcttcaggttaattttggaatgcccttgctgagaggaggggtctgttcagatgaccgaggggctcagaattttatttttgctctacaatggattaataaatagtgactggtgcatataaattcagaaatgtgcattaattattattcagtggtgatgcaattatctcatgttcatgggaccactaagtggtggaatcaggggtcaaatttaggcatgggttccagtgtcacatgctttctattggccatatggcttctctggttggaaggtttcaacactaccatagttatccctttcctactgtatccttctactgcctcagccgtctttctcagtgtcaggcctctgagcccaagccaagccatcgcatcccctgtgacttgcacatatatgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcaacccccactcctgcccgccagggaacaaaccccctttgactgtaattttcctttacctacccaaatcctataaaacggccccacccttatcttccttcgctgactctcttttcggactcagcccgcctgcacccaggtgaaataaacagccatgttgctcacacaaagcctgtttggtggtctcttcacacggacgcgcatgaaatttggtgccgtaactcggatcggggaacctctcttgggagatcaatcccctgtactcctgttctttgctccatgagaaagatccacctatgacctcaggtcctcagaccgaccagcccaaggaacatctcaccaatttcaaatcaggtaagtggcctcttcttactctcttctccaacctctctgtccctcaaccactttctcctttccactcttcaatctctcccttctcttaatttcaattcctttcattttctgggagagacaaaggagaaacgttttatccgtggacccaaaactccggcgccggtcacagactgggaaggcagccttcccttagtgtttaatcactgcaggaatgcctctctgattatacacccacgtttcaagggtgtcagaccacgcagggacgcctgccttggtccttcacccttagtggcaagtcccgcttttctagggaaggggcaagtacctcaaacccttctctccttgtctctaccccttctctgcttttctgggataggggcaagtacccctcaaccccttctccttcacccttagcggcaagtcccgcttttctacgggacaagaacccccaatcccttatttccacaccccaacctcttatctctgtgccccaatcccttatttacgtgccccaacctcttatctctgtgccccaattccttatttccatgccccaaccctttctctgcttttctggagggcaagaacccccaaccccttctccgtgtctctactcttttctctggccttgcctccttcactatgggcaagcttccaccttccattcctccttcttctcccttagcctatattcttaagaacttaaaacctcttcaactctcacctgacctaaaatctaagcatcttattttcttctgcaatgccgcttgaggccaatacaaactcgacagtagttccaaatagccggaaaatggcactttcaatttttccatcctacaagatctaaataattcttgtcgtaaaatgggcaaatatggtctgaggtgcctgacgtccaggcattcttttacacatcagtcccttcctagtctctgtgcccagtgcaactcgtcccaaatcttccttctttccctcccgcctgtcccctcagtcccaaccccaagcgtcgctgagtctttctaatcttccttttctacagacccatctgacctctcccctcctcgccaggccaagctaggtcccaattcttcctcagcctccgctcctccaccctgtaatctttttatcgcctcccctcctcacacctggtccggcttacagtttcgttcagtgactagccctcccccacctgcccagcaatttactcttaaaaaggtggctggagccaaaggcatagtcaaggttaatgctcctttttctttatcccaaatcagaagcgtttaggttctttttcatcaaatataaaaacccagcccagttcatggctcattcggcagcaaccctgagacgctttacagccctagaccctaaaaggtcaaaaggccatcttattctcaatatacattttattacccaatctgctcccgacattaaataaaactccaaaaattagaatctggccctcaaaccccacaacaggacttaattaacctcaccttcaaggtgtacaataataaaaaaaaaagttgcaattccttccctccactgtgagacaaaccccagccacatctccagcacacaagaacttccaaacgcctgaaccgcagcggccaggcgttcctccagaacctcctcccccaggagcttgctacaagtgccagaaatctggccaccaggccaaagaatgcctgcagcccaggattcctcctaagccgtgtcccatctgtgcgggaccccactggaaatcggactgttcaactcacctggcagccactcccagagcccctggaactctggcccaaggctctctgactgactccttctcggcttagcggctgaagactgacgctgcctgatcgccttggaagccccgtagaccatcatggacgccgagcttcaggtaactctcacagtggaaggtaagtccgtccccttcttaatcaatatggaggctacccactccgcattaccttcctttcaaaggcctgtttcccttgcctccataactgttgtaggtattgacagccaggcttctaaacctcttaaaactcccccactctggtgccaacttagacaatactcttttacgcactcctttttagttatccccacctgcccagttcccttattaggccgagacactttaactaaattatctgcttccctgactactcctggattacacctgcatctcattgctgcccttcttcccaatccagagcctcctttgcgtcctcctcttgtatcccccaccttaacccacaagtataagatacctctactccctccttggcgaccgatcaagcacgccttaccatctcattaaaacctaatcacccttacgccgctcaacgccaatatctcatcccacagcatgctttgaaaggattaaagcctgttatcactcgcctgctacagcatgggcttttaaaacctataaactctccttaccattcccccattttacctgtcctaaaaccagacaagccttacaagttagttcagaatctgcgccttatcaaccaaatgttttgcctatccaccccgtggtgccaaacccatatactcttctatcctcaatacctccctctactacccattattctgttctggatctcaaacatgctttctttactattcctttgcacccttcatcccagcctccctttgctttcacttagactgaccctgacacccattaggctcagcaaattacctgggctgtactgccgcaaggcttcacagacagcccccattacttcagtcaagcccaaatttcatcctcatctgttacctatctgggcataattctcataaaaacacaggtgctctccctgctgatcatgtccgaataatctcccaaacctcaatcccttacaaaacaacaactcctttccttcctaggcatggttagcgtggtcggaattcttacacaatagccaggaccacaccgtgtagcctttctgtccaaacaacttgaccttactgttttagcctagccctcatgtctgcctgcagcagctgccactgctttaatatttttagaggccctcaaaatcacaaactatgctcaactcactctctacatttctcataacttccaaaatctattttcttcctcatacctgacgcatatactttctgcttcccggctccttcagctgtactcactctttgttaagtcccacaattaccattgttcctggcccggacttcaatccggcctcccacattattcctgataccacacctgacccccatgactgtatctctctgatccacctgacattcaccccatttccccaaatttccgtctttcctgttcctcaccctgatcacgcttgatttattgatggtggttccaccaggcctaatcaccacacaccagcaaaggcaggctatgctatagtacaagccactagcccgcctcttagaacctctcgtttcctttccatcgtggaaatctatcctcaaggaaataacttctcagtgttccatctgctattctactactcctcagggattattcaggccccgtcccttccctacacatcaggctcgaggatttgcccccacccaggactggcaaattagctttactcaacatgcccagagtcaggaaactaaaatacctcttagtctaggtagacactttcactggataggtacaggcctttcctacagggtctgagaaggccaccgcagtcatttcttcccttctgtcagacataattcctcagtttagccttcccacctctataccgtctgataacagaccagcctttattagtcaaatcagccaagcagtttttcaggctcttagtattcagtgaaacctttatatcccttatagtcctccatcttcaagaaaagtagaacggactaaaggtcttttaaaaacacacctcaccaagctcagccaccaacttaaaaaggactggacaatacttttaccactttcccttctcagaaatcaggcctgtcctcagaatgctacagggtacagcccatttgagctcctgtatagatgctcctttttattaggccccagtctcattccagacaccagaccaacttagactgtgccccccaccaaaaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgccgaatctccttaggcactctctaatcagatgtcctaggtcctcccaattcttagaccttttatacctgtttttctccttctcttattccatttagtttttcaattcatacaaaaccgtatccaggccatcaccaatcattctatacgacaaatgtttcttctaacatccccacaatatcaccccttaccacaagacctcccttcagcttaatctctcccactctaggctcccacgccgcccctaatcccactcgaagcagccctgagaaacatcgcccattctctctccataccaccccccaaaaattttcaccaccccaacacttcaacactattttgttttatttttcttattaagaaggcaggaatgtcaggcctctgagcccaagccaagccatcgcatcccctgtgacttgcacatatatgcccagatggcctgaagtaactgaagaatcacaaaagaagtgaaaatgccctgccccaccttaactgatgacattccaccacaaaagaagtgtaaatggccggtccttgccttaactgatgacattaccttgtgaaagtccttttcctggctcatcttggctcaaaaacacccccactgagcacctcgcaacccccactcctgcccgccagagaacaaaccccctttgactgtaattttcctttacctacccaaatcctataaaacggccccaccgttatctcccttcgctgactctcttttcggactcagcccgcctgcacccaggtgaaataaacagccatgttgctcacacaaagcctgtttggtggtctcttcacacggacgcgcatgttggctcaatctggaaaggtgggagtgcttgaagcagaggctttcaggtcataggtagatttaaagattttgtgattgtcaattggttgcaacagttattatctaaagacctgaaatcaatagaaaggaatatctgggttatgataaggggttgtggagcaaggttttaccatgcagatgaagcctccgggtagcaggcttcagagagaatacattgtaaatgtttcttatcagacttaccatccgtgtttaagtgaatgctggttggcttttccagaattccaaaaggaaggaggatataatgagccatgtttgatcccactccccataatgacctgaactagttcttcaggttaattttggaatgcccttgctgagaggaggggtctgttcagatgaccgaggggctcagaattttatttttgctctacaatggattagtaagtagtgactggtgcatataaattcagaaatgtgcattaattattattcagtggtgatgcaattatctcatgttcatgggaccattaaatggtggaatcaggggtcaaatttaggcatgggttccagtgtcacatgctttctattggccatatggcttctctggttggaaggtttcaacactaccatagttatccctttcctactgtatccttctactgcctcagccttctttctcagagtgtgccccataagtttctgaatgagactgattctcactaccattaagttagaagggtctctcctacaaacgtgcttaccccaaagagggtcccttttcagcagagtagctctagagggaatcatcacaatgcttggttagcgtgttctgccctttgcttttttgcatggaaaattttaaatgtgagtgatcctggagcttgcagtcttgactggttcactcgttagtatccgagagagatcagatactctgccctccattctaaggcctagggctatgtttgacgaaaccaaaataatagtccaacgtttcttgattgtcaattttctcccagtaatagtgtttaaaaagtagtgactaagtaatccaaataatgaggacaagattattaatagttggtattgttaatgtaaaatgttaatgatcttagaagttctgcaaattctcttatggagatgtgtcaatgtacatttgaagatggtgaaattcagtaaggccaagatatcagagctgggaaatggaaagtgttcatcaaaggtctgggggtggcagttattcgcatcctgttctttattctttcgagttaaaattcaggcactgacaattccaggataaaaatctatttctccttacatataaatcagccatgattattcttaactaggaacagccagggtgtgtgcataatcatttaaattgagagctgaataatggatcttgattagcaatacattgaagcaaatgtgggggagaaattagagtgcttctctgtttgtttcatgcctagaatatattaactttggggaaatggcccatttttacagatgagctcaggaaatactccatatgattcaggattctttttcccaaagtattatttcgcaatgcagacatcaatagtggtgtattagctgaggtttagaaaggacaaagatagattattgaaattttctttttgtaggtacagagtaggtttatatatttatggactgcatgagatatgttgatacaggcatgccatgcattataaacacatcatggaaaatggagtatccatcccctcaagcatgtatcctttttaattcaggataccattttcctaatattctgtaatattttattgttgggttattttcaaaggcttattaagatcttaacttacactcccatcttttgtttaaattgatggctgtattagtcggttttcaaactgctataaagatatatctgggactgggtaatttataaaggaaagaggcttaattgaatcacagctctgcatggctggagaggctgcaggaaacttacaatcatggtgcaaggggaagcaagcacatcttccatggtggcaggagagagaggagcaacagtagggaaacctgccttataaaaccatcagatctcatgaaaactcactcactgtcacactacagcatggaggaaactggccccatgatccaatcacctccctcccttaacacgtggggattacaattcgaggtgagatttgggtggggacacagagccaagccatatccatgaacgatggaataacgtaattatttagaaacagcaaattgtgtggtgtaatggtattac
